United States Patent 7,745,391 (HUMAN THROMBOSPONDIN POLYPEPTIDE) - sequence listing, part 123

SEQ ID NO: 349053 - DNA, 564 bp, Homo sapiens
cttctccccttatattaaaaacacaatttttcaattatagaactctgatctcttatcaagcacataattcatttaacaagttattttttagtacattcctaaatagtatgtttcaggttctgttcagaaactatggcttagaattttagacaggcttaaacaggactagatctggcttcatagattattacattcttttgttgctatgctactaaatgtaagaatggtttgaaacaggacctccaatttcacccaaaaacatgcaagttctctttcttaaattccatataatcacttgagtatcacaggactgaaaaagaacacatgaatttgtttgctacataaagagctacatttagaaggccatgtgactagaagagaagatttatgcaattcttaaacaggtttggtatctttattctcttctgctacaatgtaatgaatactctattgtattgttacttacaaaaatgaaaaataactgctcattcagttctttctaatactcccgtaagctctgaatgtgggaatgtgcagaatttcccaccactcccatcatgccaa

SEQ ID NO: 349054 - DNA, 850 bp, Homo sapiens
cttctccccttatattaaaaacacaatttttcaattatagaactctgatctcttatcaagcacataattcatttaacaagttattttttagtacattcctaaatagtatgtttcaggttctgttcagaaactatggcttagaattttagacaggcttaaacaggactagatctggcttcatagattattacattcttttgttgctatgctactaaatgtaagaatggtttgaaacaggacctccaatttcacccaaaaacatgcaagttctctttcttaaattccatataatcacttgagtatcacaggactgaaaaagaacacatgaatttgtttgctacataaagagctacatttagaaggccatgtgactagaagagaagatttatgcaattcttaaacagttatggaggttaagaagtccatggtcgaggggctacatctgctaagagcctccttgctggtggggactctccaagaatcccaggacaacagagagcatcacagggcaagggggctgagtgtgctcatgtgctcactcaagtctctcttccttttcttacaaagccaccagtcccactcccatgataaccccttaatccattaattcatgaatggatcaatcacttcttaaaggcctcacctctcaacactctcacattgaggatgaaatttcaacatgagttttggagaggacaaatatgtaaactatagtacatcacaatatcaataacacaaaatgtataccaaaagagaggtacatttgacttttgaaaagccaggtttgaactacatgggtccacttatacacagatttttttcaataaatatatttggaaaaatttttgga

SEQ ID NO: 349055 - DNA, 946 bp, Homo sapiens
ggaagacacggtaatttttgatgccctgtggtcgtggtcttcacgtaaacgctatttgtgttccgaatcttagagttgtgtgggaaggggatccgaggagacatgaggatcataaaagctgcccgatgtcaccatggtcgcgtgcctgtggggctgtaaaggcagacttagacaagagcaggggactgcagtgggctctgagccactgtgtgtcagtggaaggatgactaagagtgtgagaaccactgcatcgctagaaccgcaccagccttctcatgtggtccaggaggcccggcaccgccattaccacgaagaccaaaatgactctccccacccacagccaaaccagagtcgtcctgtgcgctctgccctgtcatcagaggggactgtcagctgccgtctgacatcctgcgtgctttggctcttaccccagtctgaccagtgtgactgtacaggatccctcttcttggccggtgaacagcgcacttagtgcccttgcagggagcctgagaacgagcaaggtagtgcgtgcggggagtgagcaaaagagagactcagcgagacaggatgtgagatggaggtggagagcaagactgcgagaggaaaatgacaagcagagagaaagggatactaagaggaagatggcaaactgaaagggaaagagactgtgtgacagggtgagacagagtgaaagagattgagccagaatgagatgcagaagggggtagggagggagtgagagggagagagacaggagagagagagagagagagagaaccccggcagcagcggcagcagtagcagcccctcccacagctgtgggctcctctcgggggcggagggggtgcctgtgagctctcagccattccctcccaacctggtgagctccaagtggttgcgggggagaggggagaatggagtaagtccttggacaagctctctcccc

SEQ ID NO: 349056 - DNA, 368 bp, Homo sapiens
aggccattttttttgttttttgtttgttgttttctttcacttttttttccagcacagctcacctcgcaccaacccccaacacactgaactcacagctggaggcattgtgctcactcctccccagagagcaggaggcttcaggttcaaatcccagccctgccttgaggatagagtcacagcccccagtagtgattctaaaagccaagtatttgttgcccccagttgacaggtaagaaagctgagggtcagggcaggttacagcctgctactgtcatgtgatgaccactttcattgcttagctcaaaacctcctcctccaggaagccttccctgaccccatccatgctccctcccagaaagggtcgacgc

SEQ ID NO: 349057 - DNA, 846 bp, Homo sapiens
agcgaggttgctgaggtgatctgatgatataggtcttgcctttcattttaactgccattctggcaactgaacgttggcagtaaacgcagcttagttgtctcagaggactcacaatgggatgtgcttatagttgttgcctcgaagagattacgatgaggacctggtgcaggaagcttcatctgaagatgtcctgggcgttcatatgttgagatgaaacggcaactacggcgactacgggagctccacctatacagcacatggaagaagtaccaagaggcgatgaagacatccttgggagttccacaacgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacgcaggcacccaaaccaacggtgacctggaagacctggaggagcatgggccagggcagacagtctctgaggaagccacagaagttcacatgatgcgacgggcgacccagacacactgcgcgaacttctgatcagggcatgtacactcagcgagctgtccaagacacaaccggcgaaccgagcgacggaccccacgagggagagaggacgaaccatactatcggggacgtacaacaacgtgggtgaaccccggacagagcctgagaaggagcatgtcgcaaaggccaagacagagatcaagacgaaacgcacagggggcacacccagtagaaagaggcacccaagcagaacgcaaagag

SEQ ID NO: 349058 - DNA, 4092 bp, Homo sapiens
  misc_feature (2870)..(2870): n is a, c, g, or t
  misc_feature (2906)..(2906): n is a, c, g, or t
  misc_feature (2938)..(2938): n is a, c, g, or t
  misc_feature (2942)..(2942): n is a, c, g, or t
  misc_feature (3028)..(3028): n is a, c, g, or t
  misc_feature (3775)..(3775): n is a, c, g, or t
  misc_feature (3908)..(3908): n is a, c, g, or t
  misc_feature (4024)..(4024): n is a, c, g, or t
  misc_feature (4053)..(4053): n is a, c, g, or t
  misc_feature (4068)..(4068): n is a, c, g, or t
agcgaggttgctgaggtgatctgatgatataggtcttgcctttcattttaactgccattctggcaactgaacgttggcagtaaacgcagcttagttgtctcagaggactcacaatgggatgtgcttatagttgttgcctcgaagagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacgctggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttcttttgtgctttcattttcttaatgacttttacctcatttttaaaacaaatccatagtatggatgatattgatgatgaaatgtcttacgatgatcatttagaggtttatttcgaacaactggcaattccacgaatgatggaataaaacatatgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatggacatctacatattcttcattcagatcaaccagtggctagcatttgccaccttttgcagtttctttctctttccataagtactttcttctctgaatcatttgaaagcaaatgaaaacagtagcctaaagtgtcagtttcaaccagaaaataacagctctgatttctcatggctcacactcgtctgaaacgactcgggtagaggctgaggaaggccgtgttgtttgtctacctgggactacacctactgaaagaagttctcaagttctgattgagttctaaaattcttttgaagattggaattcttcctatgtaaaaagagaagagaaagacattcttgattttggtgactagagttgtagatgctggaagctttgccactaacattgatgaaccagatgcatgtcaccagcccatcacggtgattcttaatgccgttaaggcaccatgggccggcactgccacgttttccaaggaacctgccagagctcctgcggaagctgctcctcgggcgatggagtccctttgctgctaggcccttcttcagtcaccacaggatgcctgccattcatgaacaggaaggagaggacgggctttgaataaaaaacaggatccaggaaatatttgtgaggccatttggacttcagtgtgaaatggtgttaaaagatgaagtcatttattcaagaagtaaacctctgccacctggactgtgctcagacatttcattgattttgtttaataaacattttctggctttgggaggtgtctctcttggtagagcacagtgtcaaagatggacaagatggacacatagtccattatttggtattgtttgtgtatgggagcggaccacaaattaatgtttggagaacaattttgtcataacacactgttgaggctcagttgtacagaactggaaaagtctttcagcttggcacatgtcctgattcagcctttgtttaacatacattccaatccggattctatcttcactggctacaaagaccacctgatacgtgcaccacgacacaggagctgctggagagggggtagtgttatcacctcaaacccacagccatatttttcaaaagccagcttagagagaggtgtactgatagctgcatagagaacatgcagtccatccattcttcccagtgatgtacatttctcaatcagtaaccacgtggtataccagccttgagtgtcacatctcccaaccataccaaatggatcacctaactggaggtggggggggcccctcagaaatgagatttcgtatttactgtaaaattgccttattttttcttttgaggtggagtctcnctctgttgcctgggctggagtgcaatggtgtgatcnctgctcactgcaacctccgcctcctgggttcnagcngttctcctgcctcagcctcccaagtagctgcaattacaggcgcatgccaccactcccagcaaatttttatatttttagtggagacngggtttcaccatgttggccaggctggtctcaaactcctgacctcaggtgatctgcccaccttggcctcccaaagttctgggattaaaggtacgagccaccgcaactggctgagaatctttttatttgctgatttgtctcttgtgtattttctttgttcagatgtctcttcagatctttttctcacttttaaattgtttttttaattgttaagaattttctgtctagtttagatataagccctttatcagacatgtgttttgcaaatattttctcctagtctgtggcttgtattctgtctcttaacagtcattttatttttacttttgaaactaaagaagaagaatggtcagctttccgttattcttgtaacagtaatggcagaaccaagtctgctaatgctacattgagcaaagaaagtcacctggtcaagtccaacattaatgaaatggggtagtacatgcaggcggcgttggggttggggagggaacaaatgcttcttgagagtaatataatctgccataccatccaggaacctacaatggctatctattaccttattctctggtttgtttaatgttcaaatctttcctaaagatccttcaacttttctggaagaatctaatctgataacaccatcaaaaacacattacttcttttggcataatttaaattgtaagacatcattcacatttatcaatgttacatatataagaactcacccaccatattcctccttgaggaattanagcatgtaattctataaccatttttataatcgtctaacaattttataatggattggctgctatcaattttttaaaagtcatggcttctccagtcatttcttgcttatcaaaattatttcatgagatgggtctntccttgtatatttgaaaatgaggtttgcttccttctacttaaaaaacaacttgaacatacctgtttggatcacatggtcttgtcctgataacttggaagaggttgcttcagcattnttcttattgttgtggtggttattattaanattgtttcatattcngtttaaaaaattaaaattttacac

SEQ ID NO: 349059 - DNA, 2349 bp, Homo sapiens
agcgaggttgctgaggtgatctgatgatataggtcttgcctttcattttaactgccattctggcaactgaacgttggcagtaaacgcagcttagttgtctcagaggactcacaatgggatgtgcttatagttgttgcctcgaagagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacgctggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttcttttgtgctttcattttcttaatgacttttacctcatttttaaaacaaatccatagtatggatgatattgatgatgaaatgtcttacgatgatcatttagaggtttatttcgaacaactggcaattccacgaatgatggaataaaacatatgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatggacatctacatattcttcattcagatcaaccagtggctagcatttgccaccttttgcagtttctttctctttccataagtactttcttctctgaatcatttgaaagcaaatgaaaacagtagcctaaagtgtcagtttcaaccagaaaataacagctctgatttctcatggctcacactcgtctgaaacgactcgggtagaggctgaggaaggccgtgttgtttgtctacctgggactacacctactgaaagaagttctcaagttctgattgagttctaaaattcttttgaagattggaattcttcctatgtaaaaagagaagagaaagacattcttgattttggtgactagagttgtagatgctggaagctttgccactaacattgatgaaccagatgcatgtcaccagcccatcacggtgattcttaatgccgttaaggcaccatgggccggcactgccacgttttccaaggaacctgccagagctcctgcggaagctgctcctcgggcgatggagtccctttgctgctaggcccttcttcagtcaccacaggatgcctgccattcatgaacaggaaggagaggacgggctttgaataaaaaacaggatccaggaaatatttgtgaggccatttggacttcagtgtgaaatggtgttaaaagatgaagtcatttattcaagaagtaaacctctgccacctggactgtgctcagacatttcattgattttgtttaataaacaacgatgcgggccgtaataaaaagaatcttaatacaaatttaattgagaaaggaagaa

SEQ ID NO: 349060 - DNA, 1528 bp, Homo sapiens
agcgaggttgctgaggtgatctgatgatataggtcttgcctttcattttaactgccattctggcaactgaacgttggcagtaaacgcagcttagttgtctcagaggactcacaatgggatgtgcttatagttgttgcctcgaagagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacgctggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttcttttgtgctttcattttcttaatgacttttacctcatttttaaaacaaatccatagtatggtaagttacatcaatatggagtatttttatgttttgtggtgatttacattctgtatgtattttacatatataaatgttaatggcctggtgcagtggctaccacctgtaatctcagcagtttgggagaccaaagcaggacgattgcttgatcccaggagtttaagaccagcctgggcaacatagtgagacctcatccctacaaaaaaaaaaaaatcc

SEQ ID NO: 349061 - DNA, 1969 bp, Homo sapiens
  misc_feature (1552)..(1552): n is a, c, g, or t
  misc_feature (1860)..(1860): n is a, c, g, or t
  misc_feature (1966)..(1966): n is a, c, g, or t
  misc_feature (1968)..(1968): n is a, c, g, or t
aggtgacaatagatatagaagtacgttgatgtgcgaagatgtattttgttttagccagcgaggaaaaaagaatcagtttgattatacatttaccaaacattaagaatttaatatggtaacttttatttcagtattaaaatagcaattttatttattacttttttatatatagaatttgacaccaaattttggaacttaaaaagaagattcttaaaacttacaatccagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacgcaggcacccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgctggcaaagagtgacctggaagacctggaggagcatgtgccagagcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaaggcaagtgaaggatgccctgagaacatgctccaggaaacagacacccactccatagcagcccctgagcctgctgggctgagccctccacaggctgcttagtgagggagacactgaggtgctggtcgcacccccatgtgcaggactccaagggctttgcactgtgttgtctgcagtaactcttcagctcaccaacatctcatttggggggacctagctctgtcttcccagccccttgaggacaacagggagcatcactagttcatcctgaggagacactagggttgacatgaatccccctggttcaggcctcctgggaaaggtgngagagggatggaggcacccccaggctccttgtcacacaagcgagcagcccacccgacccagtattgcaggccagcaggccctcagtaggtcctggtgtcaagcaggggacacggcaggatccaagaagcactgaaatgtgtccagtcccaggagtccttcagccttggggggtctgggggcctccagttccaggggtccttcagcctctgtgggggcctggggtggcctcatggccccctttttcaagatgaggttggaggcttctgtatgtagagggcactggcttgggccaaatgccaacaaaacnaacccttgaagacatttcagggccatgctcacttgggagggtttgaggacatgatttagcgagcctctgttttttaaatatattttccaatcttgaaataaggtanana

SEQ ID NO: 349062 - DNA, 4603 bp, Homo sapiens
  misc_feature (3381)..(3381): n is a, c, g, or t
  misc_feature (3417)..(3417): n is a, c, g, or t
  misc_feature (3449)..(3449): n is a, c, g, or t
  misc_feature (3453)..(3453): n is a, c, g, or t
  misc_feature (3539)..(3539): n is a, c, g, or t
  misc_feature (4286)..(4286): n is a, c, g, or t
  misc_feature (4419)..(4419): n is a, c, g, or t
  misc_feature (4535)..(4535): n is a, c, g, or t
  misc_feature (4564)..(4564): n is a, c, g, or t
  misc_feature (4579)..(4579): n is a, c, g, or t
agcgaggttgctgaggtgatctgatgatataggtcttgcctttcattttaactgccattctggcaactgaacgttggcagtaaacgcagcttagttgtctcagaggactcacaatgggatgtgcttatagttgttgcctcgaagtgtgttgtggcgaggatgaaatagtgtatcctaggatgccaggggaatccaccgtctgccaccgcgagcgtgagaagccaatcacctatcactggtatcactggcatcccggccatatataccctagaattgcatcaatggaagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtgagcgtgacgaaggctccttgggcaagccattgtgtccacccgagatactctcggagacgttgccaggctctgtgaagaaaagggtatgctttccatcagaagatcatctagaggagtttatagcagaacatctccctgaagcatccaatcagagtctcctcactgttgcccatgcagacgcaggcacccaaaccaacggtgacctggaagacctggaggagcatgggccagggcagacagtctctgaggaagccacagaagttcacatgatggagggggacccagacacactggccgaacttctgatcagggatgtacttcaggagctgtccagttacaacggcgaggaggaggacccagaggaggtgaagacatccttgggagttccacaacgtggtgacctggaagacctggaggagcatgtgccagggcagacagtctctgaggaagccacaggggttcacatgatgcaggtggacccagccacgctggcaaagagtgacctggaagacctggaggagcatgtgccagagcagacagtctctgaggaagccacaggggttcacatgatgcaggtggacccagccacactggcaaagcaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttcttttgtgctttcattttcttaatgacttttacctcatttttaaaacaaatccatagtatggatgatattgatgatgaaatgtcttacgatgatcatttagaggtttatttcgaacaactggcaattccacgaatgatggaataaaacatatgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatggacatctacatattcttcattcagatcaaccagtggctagcatttgccaccttttgcagtttctttctctttccataagtactttcttctctgaatcatttgaaagcaaatgaaaacagtagcctaaagtgtcagtttcaaccagaaaataacagctctgatttctcatggctcacactcgtctgaaacgactcgggtagaggctgaggaaggccgtgttgtttgtctacctgggactacacctactgaaagaagttctcaagttctgattgagttctaaaattcttttgaagattggaattcttcctatggcaccatgggccggcactgccacgttttccaaggaacctgccagagctcctgcggaagctgctcctcgggcgatggagtccctttgctgctaggcccttcttcagtcaccacaggatgcctgccattcatgaacaggaaggagaggacgggctttgaataaaaaacaggatccaggaaatatttgtgaggccatttggacttcagtgtgaaatggtgttaaaagatgaagtcatttattcaagaagtaaacctctgccacctggactgtgctcagacatttcattgattttgtttaataaacattttctggctttgggaggtgtctctcttggtagagcacagtgtcaaagatggacaagatggacacatagtccattatttggtattgtttgtgtatgggagcggaccacaaattaatgtttggagaacaattttgtcataacacactgttgaggctcagttgtacagaactggaaaagtctttcagcttggcacatgtcctgattcagcctttgtttaacatacattccaatccggattctatcttcactggctacaaagaccacctgatacgtgcaccacgacacaggagctgctggagagggggtagtgttatcacctcaaacccacagccatatttttcaaaagccagcttagagagaggtgtactgatagctgcatagagaacatgcagtccatccattcttcccagtgatgtacatttctcaatcagtaaccacgtggtataccagccttgagtgtcacatctcccaaccataccaaatggatcacctaactggaggtggggggggcccctcagaaatgagatttcgtatttactgtaaaattgccttattttttcttttgaggtggagtctcnctctgttgcctgggctggagtgcaatggtgtgatcnctgctcactgcaacctccgcctcctgggttcnagcngttctcctgcctcagcctcccaagtagctgcaattacaggcgcatgccaccactcccagcaaatttttatatttttagtggagacngggtttcaccatgttggccaggctggtctcaaactcctgacctcaggtgatctgcccaccttggcctcccaaagttctgggattaaaggtacgagccaccgcaactggctgagaatctttttatttgctgatttgtctcttgtgtattttctttgttcagatgtctcttcagatctttttctcacttttaaattgtttttttaattgttaagaattttctgtctagtttagatataagccctttatcagacatgtgttttgcaaatattttctcctagtctgtggcttgtattctgtctcttaacagtcattttatttttacttttgaaactaaagaagaagaatggtcagctttccgttattcttgtaacagtaatggcagaaccaagtctgctaatgctacattgagcaaagaaagtcacctggtcaagtccaacattaatgaaatggggtagtacatgcaggcggcgttggggttggggagggaacaaatgcttcttgagagtaatataatctgccataccatccaggaacctacaatggctatctattaccttattctctggtttgtttaatgttcaaatctttcctaaagatccttcaacttttctggaagaatctaatctgataacaccatcaaaaacacattacttcttttggcataatttaaattgtaagacatcattcacatttatcaatgttacatatataagaactcacccaccatattcctccttgaggaattanagcatgtaattctataaccatttttataatcgtctaacaattttataatggattggctgctatcaattttttaaaagtcatggcttctccagtcatttcttgcttatcaaaattatttcatgagatgggtctntccttgtatatttgaaaatgaggtttgcttccttctacttaaaaaacaacttgaacatacctgtttggatcacatggtcttgtcctgataacttggaagaggttgcttcagcattnttcttattgttgtggtggttattattaanattgtttcatattcngtttaaaaaattaaaattttacac

SEQ ID NO: 349063 - DNA, 4072 bp, Homo sapiens
  misc_feature (2850)..(2850): n is a, c, g, or t
  misc_feature (2886)..(2886): n is a, c, g, or t
  misc_feature (2918)..(2918): n is a, c, g, or t
  misc_feature (2922)..(2922): n is a, c, g, or t
  misc_feature (3008)..(3008): n is a, c, g, or t
  misc_feature (3755)..(3755): n is a, c, g, or t
  misc_feature (3888)..(3888): n is a, c, g, or t
  misc_feature (4004)..(4004): n is a, c, g, or t
  misc_feature (4033)..(4033): n is a, c, g, or t
  misc_feature (4048)..(4048): n is a, c, g, or t
agcgaggttgctgaggtgatctgatgatataggtcttgcctttcattttaactgccattctggcaactgaacgttggcagtaaacgcagcttagttgtctcagaggactcacaatgggatgtgcttatagttgttgcctcgaagagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacgctggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttcttttgtgctttcattttcttaatgacttttacctcatttttaaaacaaatccatagtatggatgatattgatgatgaaatgtcttacgatgatcatttagaggtttatttcgaacaactggcaattccacgaatgatggaataaaacatatgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatggacatctacatattcttcattcagatcaaccagtggctagcatttgccaccttttgcagtttctttctctttccataagtactttcttctctgaatcatttgaaagcaaatgaaaacagtagcctaaagtgtcagtttcaaccagaaaataacagctctgatttctcatggctcacactcgtctgaaacgactcgggtagaggctgaggaaggccgtgttgtttgtctacctgggactacacctactgaaagaagttctcaagttctgattgagttctaaaattcttttgaagattggaattcttcctatgtaaaaagagaagagaaagacattcttgattttggtgactagagttgtagatgctggaagctttgccactaacattgatgaaccagatgcatgtcaccagcccatcacgggcaccatgggccggcactgccacgttttccaaggaacctgccagagctcctgcggaagctgctcctcgggcgatggagtccctttgctgctaggcccttcttcagtcaccacaggatgcctgccattcatgaacaggaaggagaggacgggctttgaataaaaaacaggatccaggaaatatttgtgaggccatttggacttcagtgtgaaatggtgttaaaagatgaagtcatttattcaagaagtaaacctctgccacctggactgtgctcagacatttcattgattttgtttaataaacattttctggctttgggaggtgtctctcttggtagagcacagtgtcaaagatggacaagatggacacatagtccattatttggtattgtttgtgtatgggagcggaccacaaattaatgtttggagaacaattttgtcataacacactgttgaggctcagttgtacagaactggaaaagtctttcagcttggcacatgtcctgattcagcctttgtttaacatacattccaatccggattctatcttcactggctacaaagaccacctgatacgtgcaccacgacacaggagctgctggagagggggtagtgttatcacctcaaacccacagccatatttttcaaaagccagcttagagagaggtgtactgatagctgcatagagaacatgcagtccatccattcttcccagtgatgtacatttctcaatcagtaaccacgtggtataccagccttgagtgtcacatctcccaaccataccaaatggatcacctaactggaggtggggggggcccctcagaaatgagatttcgtatttactgtaaaattgccttattttttcttttgaggtggagtctcnctctgttgcctgggctggagtgcaatggtgtgatcnctgctcactgcaacctccgcctcctgggttcnagcngttctcctgcctcagcctcccaagtagctgcaattacaggcgcatgccaccactcccagcaaatttttatatttttagtggagacngggtttcaccatgttggccaggctggtctcaaactcctgacctcaggtgatctgcccaccttggcctcccaaagttctgggattaaaggtacgagccaccgcaactggctgagaatctttttatttgctgatttgtctcttgtgtattttctttgttcagatgtctcttcagatctttttctcacttttaaattgtttttttaattgttaagaattttctgtctagtttagatataagccctttatcagacatgtgttttgcaaatattttctcctagtctgtggcttgtattctgtctcttaacagtcattttatttttacttttgaaactaaagaagaagaatggtcagctttccgttattcttgtaacagtaatggcagaaccaagtctgctaatgctacattgagcaaagaaagtcacctggtcaagtccaacattaatgaaatggggtagtacatgcaggcggcgttggggttggggagggaacaaatgcttcttgagagtaatataatctgccataccatccaggaacctacaatggctatctattaccttattctctggtttgtttaatgttcaaatctttcctaaagatccttcaacttttctggaagaatctaatctgataacaccatcaaaaacacattacttcttttggcataatttaaattgtaagacatcattcacatttatcaatgttacatatataagaactcacccaccatattcctccttgaggaattanagcatgtaattctataaccatttttataatcgtctaacaattttataatggattggctgctatcaattttttaaaagtcatggcttctccagtcatttcttgcttatcaaaattatttcatgagatgggtctntccttgtatatttgaaaatgaggtttgcttccttctacttaaaaaacaacttgaacatacctgtttggatcacatggtcttgtcctgataacttggaagaggttgcttcagcattnttcttattgttgtggtggttattattaanattgtttcatattcngtttaaaaaattaaaattttacac

SEQ ID NO: 349064 - DNA, 2001 bp, Homo sapiens
agcgaggttgctgaggtgatctgatgatataggtcttgcctttcattttaactgccattctggcaactgaacgttggcagtaaacgcagcttagttgtctcagaggactcacaatgggatgtgcttatagttgttgcctcgaagagattacgatgaggacctggtgcaggaagcttcatctgaagatgtcctgggcgttcatatggtggacaaagacacagagagagacattgagatgaaacggcaactacggcgactacgggagctccacctatacagcacatggaagaagtaccaagaggcgatgaagacatccttgggagttccacaacgtggtgacctggaagacctggaggagcatgtgccagggcagacagtctctgaggaagccacaggggttcacatgatgcaggtggacccagccacgctggcaaagaaattggaagactccaccattacaggcagccaccagcagatgtcagcaagtccttcctctgcacctgcagaagaagcaacagaaaagaccaaagtggaagaggaagtgaaaaccagaaagcccaagaagaaaaccaggaagcccagcaagaaaagccggtggaatgtcctgaaatgttgggacatttttaatatattttagagacctctgaagattcctcgaccaccaggaagggccccgacgtggggatgtcaacatggctcagacttgatgtggatcgtgatcatttcgggaaatgtgttactccaaaaacttttataatctttgcttaatttgtttttaaatactttcctggctgggcgtggtggcttatgcctgtaatcccagcactttgggaggccgaggcgggtggatcacctgaggtcaggagttcaagaccagcctggccaacaaggtgaaaccccgtctctactaaaaatacaaaaattagctaggcgtggtggcgcactcttgtagtcccagctatttgggaggctgaggcaggagaatcacttgaactcaggaggcggaggttgcggtgagccgagatcatgccactgcaccccagcacctggctacagagtgagactttgtctcaaaaaaaaaaaaaaaagaacaaaaaaattctgactttaacctctgtttttcagagggcacaaattgttcttgtattgtttccattttacatttttttcttgaagttattttccaattgttttcattctttctgaagttttgtttactcggttttaagtttttgtaattttgatagacttcttttgtgctttcattttcttaatgacttttacctcatttttaaaacaaatccatagtatggatgatattgatgatgaaatgtcttacgatgatcatttagaggtttatttcgaacaactggcaattccacgaatgatggaataaaacatatgaagtagaaggactggaacctccagaaaaagtactttaagttacctacaggtgatcctagtcaggtatgaattgataagaaatgcctgcaccttccctccttcctatctttcccttgcctacagaaaattaaaaggcaaaacaatggacatctacatattcttcattcagatcaaccagtggctagcatttgccaccttttgcagtttctttctctttccataagtactttcttctctgaatcatttgaaagcaaatgaaaacagtagcctaaagtgtcagtttcaaccagaaaataacagctctgatttctcatggctcacactcgtctgaaacgactcgggtagaggctgaggaaggccgtgttgtttgtctacctgggactatattccacggagacgatgctgaactatctgggagtgaagtgtctgatatctaaaacttactctaaaaaagttcagcaacaacaaaaaggatgcaaacaggagaaagaaagcaaagatggcaaaaagattctgacctgtaactaacagaagaaactgcttcggcatatttggtgggaaacatacttaaccaaccaccagcaaacctcctcacca

SEQ ID NO: 349065 - DNA, 559 bp, Homo sapiens
ccatacacactataggtgactgacagaatttcttggtgggcaaatgccagagttcattatcaactaaacagtggtttcagatggcatccacacttacaaactgtgtgtcaacaggcattttccttaagagaaattccttcttcttgagaagaatttggaattgtcaaagaaaaacaattgaaaatgttgcacagaaatcctgtgcctttccaggaatgtcttctagataccggggccattgtctcaaccactgtttaccatctggctttttaacgtcaacaagtgaagacctgtgcacacaggagacagcatggtctgaccctcatagtgttttctttttctctagatgcaggtggacccagccacactggcaaagcgtacgtattctgggatcatctctttgtttaggtgtgaaatcttagtgttgtaaaggtagtgctgcttcacctgcttttgctcaagggccactctggtttgagctttctgccagaaatgagatttgggaattttggtttaaaaactactaagagtcacaccgggcacagtggctcacgcctgt

SEQ ID NO: 349066 - DNA, 424 bp, Homo sapiens
tcgacaaacgtgcaaggaaaagtgaacctctactactcactcttactgtggacatagcattaatgttagatggattttagaatgaactgtaaaaggctaaaactgtaaagttttaagaagaaaacagtattttcacaatgtaaagtaggcagattgcttaccacacaaaaaccacaagctgtgaaagaaaaaaaaagatgaacttcatattaaaaacttatacctaaagtcatcattagaaagtcagagcaacggctgggcgtggtggcgcaggcctgtaatcccaacactttgggaggccaaggcgggcggatcacctgaggtcaggagttcaagaccagcccggccgacgtggtgaaaccccgtctctactaaaaatacaaaaaaaaaaaaaattagccgagcgtggtgacaggtgcctgta

SEQ ID NO: 349067 - DNA, 1553 bp, Homo sapiens
tggaaattgatgagaaaacagcttctgcatagtagctaatgcttatgtccatgtgtggttcttttgtagcgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctgaggcctcagcagccgccttaagctgatcctgcggagaacacccttggtggcttatgggtccccctcagcaagccctacagagctgtggaggattgctatctggaggccttccagctgctgtcttctggacaggctctgcttctccaaggaaaccgcctagtttactgttttgaaatcaatgcaagagtgattgcagctttatgttcatttgtttgtttgtttgtctgtttgtttcaagaacctggaaaaattccagaagaagagaagctgctgaccaattgtgctgccatttgattttctaaccttgaatgctgccagtgtggagtgggtaatcccaggcacagctgagttatgatgtaatctctctgcagctgccgggcctgatttggtacttttgagtgtgtgtgtgcatgtgtgtgtgtgtgtgtgtgtgtgtgtgtgtgtatgtgagagattctgtgatcttttaaagtgttactttttgtaaacgacaagaataattcaattttaaagactcaaggtggtcagtaaataacaggcatttgttcactgaaggtgattcaccaaaatagtcttctcaaattagaaagttaaccccatgtcctcagcatttcttttctggccaaaagcagtaaatttgctagcagtaaaagatgaagttttatacacacagcaaaaaggagaaaaaattctagtatattttaagagatgtgcatgcattctatttagtcttcagaatgctgaatttacttgttgtaagtctattttaaccttctgtatgacatcatgctttatcatttcttttggaaaatagcctgtaagctttttattacttgctataggtttagggagtgtacctcagatagattttaaaaaaaagaatagaaagcctttatttcctggtttgaaattcctttcttccctttttttgttgttgttattgttgtttgttgttgttattttgtttttgtttttaggaatttgtcagaaactctttcctgttttggtttggagagtagttctctctaactagagacaggagtggccttgaaattttcctcatctattacactgtactttctgccacacactgccttgttgcaaagtatccatcttgtctatctcccggcacttctgaaatatattgctaccattgtataactaataacagattgcttaagctgttcccatgcaccacctgt

SEQ ID NO: 349068 - DNA, 2591 bp, Homo sapiens
aacctctccgcgcgaagacggcttcagccctgcagggaaagaaaagtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctgaggcctcagcagccgccttaagctgatcctgcggagaacacccttggtggcttatgggtccccctcagcaagccctacagagctgtggaggattgctatctggaggccttccagctgctgtcttctggacaggctctgcttctccaaggaaaccgcctagtttactgttttgaaatcaatgcaagagtgattgcagctttatgttcatttgtttgtttgtttgtctgtttgtttcaagaacctggaaaaattccagaagaagagaagctgctgaccaattgtgctgccatttgattttctaaccttgaatgctgccagtgtggagtgggtaatcccaggcacagctgagttatgatgtaatctctctgcagctgccgggcctgatttggtacttttgagtgtgtgtgtgcatgtgtgtgtgtgtgtgtgtgtgtgtgtgtgtgtatgtgagagattctgtgatcttttaaagtgttactttttgtaaacgacaagaataattcaattttaaagactcaaggtggtcagtaaataacaggcatttgttcactgaaggtgattcaccaaaatagtcttctcaaattagaaagttaaccccatgtcctcagcatttcttttctggccaaaagcagtaaatttgctagcagtaaaagatgaagttttatacacacagcaaaaaggagaaaaaattctagtatattttaagagatgtgcatgcattctatttagtcttcagaatgctgaatttacttgttgtaagtctattttaaccttctgtatgacatcatgctttatcatttcttttggaaaatagcctgtaagctttttattacttgctataggtttagggagtgtacctcagatagattttaaaaaaaagaatagaaagcctttatttcctggtttgaaattcctttcttccctttttttgttgttgttattgttgtttgttgttgttattttgtttttgtttttaggaatttgtcagaaactctttcctgttttggtttggagagtagttctctctaactagagacaggagtggccttgaaattttcctcatctattacactgtactttctgccacacactgccttgttgcaaagtatccatcttgtctatctcccggcacttctgaaatatattgctaccattgtataactaataacagattgcttaagctgttcccatgcaccacctgt

SEQ ID NO: 349069 - DNA, 2696 bp, Homo sapiens
cgccgctgtgcccaccccctcgccggagagagtgctggtaactccttccccagagtctgattacctgctccgcgaggccgcggacacgtgcggagagccgactgacactcgcagccccctcgggaggcccgacgcgactgggcccctcaggtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctgaggcctcagcagccgccttaagctgatcctgcggagaacacccttggtggcttatgggtccccctcagcaagccctacagagctgtggaggattgctatctggaggccttccagctgctgtcttctggacaggctctgcttctccaaggaaaccgcctagtttactgttttgaaatcaatgcaagagtgattgcagctttatgttcatttgtttgtttgtttgtctgtttgtttcaagaacctggaaaaattccagaagaagagaagctgctgaccaattgtgctgccatttgattttctaaccttgaatgctgccagtgtggagtgggtaatcccaggcacagctgagttatgatgtaatctctctgcagctgccgggcctgatttggtacttttgagtgtgtgtgtgcatgtgtgtgtgtgtgtgtgtgtgtgtgtgtgtgtatgtgagagattctgtgatcttttaaagtgttactttttgtaaacgacaagaataattcaattttaaagactcaaggtggtcagtaaataacaggcatttgttcactgaaggtgattcaccaaaatagtcttctcaaattagaaagttaaccccatgtcctcagcatttcttttctggccaaaagcagtaaatttgctagcagtaaaagatgaagttttatacacacagcaaaaaggagaaaaaattctagtatattttaagagatgtgcatgcattctatttagtcttcagaatgctgaatttacttgttgtaagtctattttaaccttctgtatgacatcatgctttatcatttcttttggaaaatagcctgtaagctttttattacttgctataggtttagggagtgtacctcagatagattttaaaaaaaagaatagaaagcctttatttcctggtttgaaattcctttcttccctttttttgttgttgttattgttgtttgttgttgttattttgtttttgtttttaggaatttgtcagaaactctttcctgttttggtttggagagtagttctctctaactagagacaggagtggccttgaaattttcctcatctattacactgtactttctgccacacactgccttgttgcaaagtatccatcttgtctatctcccggcacttctgaaatatattgctaccattgtataactaataacagattgcttaagctgttcccatgcaccacctgt

SEQ ID NO: 349070 - DNA, 856 bp, Homo sapiens
aacctctccgcgcgaagacggcttcagccctgcagggaaagaaaagtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggtgagccagggagctgcgccctcgccatctggggcctcgcgcgcgcggggagggccgagccgggaatcctcaggcccagaaaggtgcggggcagagggcgactggggaggtcctgcgcgacctgttggtcttacagagtgagagttaagttttgtcgacagagccgcgagccagagccggtgaccttgccagacagcgagccgaaagacaagtc

SEQ ID NO: 349071 - DNA, 2661 bp, Homo sapiens
agggtagcgatggaggcttcgtaaaggaggaggaggggagtctggaggaaccccgaggaaggcttctgggctgtctgattgcactttcttcttatcctcccgtctcctcctttaggtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagcctctttttcgtggaagttcagatgttgatcaactaggaaaaatcttggacgtgattggactcccaggagaagaagactggcctagagatgttgcccttcccaggcaggcttttcattcaaaatctgcccaaccaattgagaagtttgtaacagatatcgatgaactaggcaaagacctacttctgaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctgaggcctcagcagccgccttaagctgatcctgcggagaacacccttggtggcttatgggtccccctcagcaagccctacagagctgtggaggattgctatctggaggccttccagctgctgtcttctggacaggctctgcttctccaaggaaaccgcctagtttactgttttgaaatcaatgcaagagtgattgcagctttatgttcatttgtttgtttgtttgtctgtttgtttcaagaacctggaaaaattccagaagaagagaagctgctgaccaattgtgctgccatttgattttctaaccttgaatgctgccagtgtggagtgggtaatcccaggcacagctgagttatgatgtaatctctctgcagctgccgggcctgatttggtacttttgagtgtgtgtgtgcatgtgtgtgtgtgtgtgtgtgtgtgtgtgtgtgtatgtgagagattctgtgatcttttaaagtgttactttttgtaaacgacaagaataattcaattttaaagactcaaggtggtcagtaaataacaggcatttgttcactgaaggtgattcaccaaaatagtcttctcaaattagaaagttaaccccatgtcctcagcatttcttttctggccaaaagcagtaaatttgctagcagtaaaagatgaagttttatacacacagcaaaaaggagaaaaaattctagtatattttaagagatgtgcatgcattctatttagtcttcagaatgctgaatttacttgttgtaagtctattttaaccttctgtatgacatcatgctttatcatttcttttggaaaatagcctgtaagctttttattacttgctataggtttagggagtgtacctcagatagattttaaaaaaaagaatagaaagcctttatttcctggtttgaaattcctttcttccctttttttgttgttgttattgttgtttgttgttgttattttgtttttgtttttaggaatttgtcagaaactctttcctgttttggtttggagagtagttctctctaactagagacaggagtggccttgaaattttcctcatctattacactgtactttctgccacacactgccttgttgcaaagtatccatcttgtctatctcccggcacttctgaaatatattgctaccattgtataactaataacagattgcttaagctgttcccatgcaccacctgt

SEQ ID NO: 349072 - DNA, 1333 bp, Homo sapiens
aacctctccgcgcgaagacggcttcagccctgcagggaaagaaaagtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtcgtcacgctgtggtacagagcacccgaagtcttgctccagtccagctacgccacccccgtggatctctggagtgttggctgcatatttgcagaaatgtttcgtagaaagtaagaaatacattttgtttcactctgctttccttgaaaagagactgtggatctttgtgaatttgagtggcagcatggcatttctatcattaggggtcatgatggccagatccatctaccccaggctaccacttgcaagcctgtcctgaaaccgccttctcagtgcttacagtgttgttttatatgactgtagcttgcagcttctggaaactctgcctgggaaggaataccccactgttcttataagttacattgttttactggtgatgataggaca

SEQ ID NO: 349073 - DNA, 389 bp, Homo sapiens
aagaaacttctgaccacagacatcctgtttcttaaaaataagcagagttaaaggtgagtaagaattcagccatgtcacataggcactgcaatggccaacaacatctgggtagggttccaggtaagtcatgtaggcagtgcaataggcaacacagtcacagaaatacctatgaaaagctgtccttttgtcagggagattagcatgtgtagaggaagtaaacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgc

SEQ ID NO: 349074 - DNA, 342 bp, Homo sapiens
attcgagctcgccaccctgctatatagcactcccatcagtgcatgacagttgacaatctgggtagggttccaggtaagtcatgtaggcagtgcaataggcaacacagtcacagaaatacctatgaaaagctgtccttttgtcagggagattagcatgtgtagaggaagtaaacatcaactgcaaatggctttctctgagaccttcttatctgctttatctggatccaggtaagattaactcacaggaaaaggaaacaaaagatctcatgcttttaaaggtctgacaggaaactttttttttttgaaacggggtcttactctgacacccaggctggagtgtgc

SEQ ID NO: 349075 - DNA, 4720 bp, Homo sapiens
ggcacgagtggcggaaaggctgcggccccgcgccagagggccggtggctcctccgggcttctgaggacccgcagggagcgggcctcatcatttctgtctcctgtttctccacttccttctctattggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtattgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacttatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctcagtctgacttggcgatatgtctaagttccccagcccttcccctgctgtgctcttgaaagaagaacttaacaattttagggtaaaaagagaccaacagaccggcacagtggctcaaacctgttgtcctagcactttgggaggctgaggcgggcggatcacctgaggtcaggagtttgagaccggcctggacaatatggcgaaatcccatctccactaaaaatacaaaaattagccggccatggtggcatgcgcctgtaatcccagccactcgggtggctgaggcaggagaattgcctgaacccaggaggcagaggttgcagtgagctaaggtcacgccagtgcatatgcctgggcgacagagcaagactctgtctcaaaaaaaaagaaaaaaaaaaaagaccaacaaccttcccttttcttccgctttccctacagaagacacagaaaagcatttttgcctctagatccttttgtctagggtaaattcttagggtgacaagagtatgcggcaggaagaaggaggagccataaaggaagagaagccagcttgttggcatggggcatagaaaaggacaaaatctaggcatgaaaaggatggataaatactgcaaatattatgttcttacccattcttggaaacgtcagctttcttgcttcctgtgcttccagccgaggtagggcaaaggtgagattgagaaaatagccattcagctcaggaaggcttctaagtaaaggatggatttggatt

SEQ ID NO: 349076 - DNA, 5279 bp, Homo sapiens
ggcacgagtggcggaaaggctgcggccccgcgccagagggccggtggctcctccgggcttctgaggacccgcagggagcgggcctcatcatttctgtctcctgtttctccacttccttctctattggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtattgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacttatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattaaaaaaaaaaaaaaaaaaaaaaaaaaaaaaaaaaaaaaaaaaaccagggacctagtcatcgagggcgcacaaagacgacagcagaagaaagggcactggacactgcggtgttacctgggaccagacctgtgttagctgaacaaggggggaaactaggcgggacccccttataggggcgccgactaaaaagtccgaaacaccagggtaccctggacttaaaggacctgcaaacgacgagaaacacaaacagaagacacgacagcacgagcaatacacacctagtgggacacacatgagggagtcaaaaagaaggatggaccaggagaggaggagacgacgggaagcgaacaacgaaaagacgcaaacaaaagaggcaggagcgaaagggtcacagaaacaaccggaaatagaagcaaagaagcagacagccggaggataagcgacacgatgtacgacgcaaaccacgaccagaagacaggaggcacaagagaagacggaagccagcgagacaaaaaagcacacacaagaaagacgccagaggaggggagggatggggcggagagggaggagggagggtgggacgggaggacgaagagaagaaagaagaggggggcagagacagggggagtggcagtgagagaaggggagagaaggaggaggaggagaagagggaagggaggaagagacacgagagatgaggagcaaggagagagacgggggcgggaagagaggaaacggggaggagagcaggagcggagaagggcgtgggcgagcacagaggaacgcaagaggacgggcggggaggcagggaagagaaggagcgaaacgggcaagaggcggagggagtagcagagaagacgagagggtgaaccgagcagcagggcgtgcggagcgaggcgagaagacggagagggaggagcaggagagg

SEQ ID NO: 349077 - DNA, 1476 bp, Homo sapiens
ttttagggtaaaaagagaccaacagaccggcacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctcagtctgacttggcgatatgtctaagttccccagcccttcccctgctgtgctcttgaaagaagaacttaacaattttagggtaaaaagagaccaacagaccggcacagtggctcaaacctgttgtcctagcactttgggaggctgaggcgggcggatcacctgaggtcaggagtttgagaccggcctggacaatatggcgaaatcccatctccactaaaaatacaaaaattagccggccatggtggcatgcgcctgtaatcccagccactcgggtggctgaggcaggagaattgcctgaacccaggaggcagaggttgcagtgagctaaggtcacgccagtgcatatgcctgggcgacagagcaagactctgtctcaaaaaaaaagaaaaaaaaaaaagaccaacaaccttcccttttcttccgctttccctacagaagacacagaaaagcatttttgcctctagatccttttgtctagggtaaattcttagggtgacaagagtatgcggcaggaagaaggaggagccataaaggaagagaagccagcttgttggcatggggcatagaaaaggacaaaatctaggcatgaaaaggatggataaatactgcaaatattatgttcttacccattcttggaaacgtcagctttcttgcttcctgtgcttccagccgaggtagggcaaaggtgagattgagaaaatagccattcagctcaggaaggcttctaagtaaaggatggatttggatt

SEQ ID NO: 349078 - DNA, 3614 bp, Homo sapiens
ggcacgagtggcggaaaggctgcggccccgcgccagagggccggtggctcctccgggcttctgaggacccgcagggagcgggcctcatcatttctgtctcctgtttctccacttccttctctattggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtattgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacttatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagagggtaatagtgcgacagcca

SEQ ID NO: 349079 - DNA, 428 bp, Homo sapiens
tgtctcaggtggagggcttgggagtagggtcaaatgtaagtttccctcatttccttaggcttttctatcccgctcctatggctccagaactgcctgatccgagcagctgatgatcgggaagaggatggtgagtggacaggtgacacttttaggagaagagccctggaggctattggagacctacctggtcatgggatggagaaccagttcttcccttatatcttcaccatatgactattgaccctgtcttaggctgctcccaggccgttccattggtgccactcacagaggaaaatgaggaagccatggaaaacgaacagtttcagcagctgttgcgcaagctaggggttcggccccctgcctctgggcaggtaaatatgtcagttacagtgtcaaccaaggcgtgttagtcctatttccaaatacat

SEQ ID NO: 349080 - DNA, 320 bp, Homo sapiens
aagtgtcatttttggatgaattgaggtaccctctttccagagacctctgatttattttactcatctctttccctgttacccttgggtattcacatgcttgctttttatagatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttggtaacaatctgaccctagctctgctggcatgggctcacttcccttgaagtggtccttaggagcagtc

SEQ ID NO: 349081 - DNA, 5114 bp, Homo sapiens
ggcacgagtggcggaaaggctgcggccccgcgccagagggccggtggctcctccgggcttctgaggacccgcagggagcgggcctcatcatttctgtctcctgtttctccacttccttctctattggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtattgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacttatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctcagtctgacttggcgatatgtctaagttccccagcccttcccctgctgtgctcttgaaagaagaacttaacaattttagggtaaaaagagaccaacagaccggcacagtggctcaaacctgttgtcctagcactttgggaggctgaggcgggcggatcacctgaggtcaggagtttgagaccggcctggacaatatggcgaaatcccatctccactaaaaatacaaaaattagccggccatggtggcatgcgcctgtaatcccagccactcgggtggctgaggcaggagaattgcctgaacccaggaggcagaggttgcagtgagctaaggtcacgccagtgcatatgcctgggcgacagagcaagactctgtctcaaaaaaaaagaaaaaaaaaaaagaccaacaaccttcccttttcttccgctttccctacagaagacacagaaaagcatttttgcctctagatccttttgtctagggtaaattcttagggtgacaagagtatgcggcaggaagaaggaggagccataaaggaagagaagccagcttgttggcatggggcatagaaaaggacaaaatctaggcatgaaaaggatggataaatactgcaaatattatgttcttacccattcttggaaacgtcagctttcttgcttcctgtgcttccagccgaggtagggcaaaggtgagattgagaaaatagccattcagctcaggaaggcttctaagtaaaggatggatttggatt

SEQ ID NO: 349082 - DNA, 5330 bp, Homo sapiens
ggcacgagtggcggaaaggctgcggccccgcgccagagggccggtggctcctccgggcttctgaggacccgcagggagcgggcctcatcatttctgtctcctgtttctccacttccttctctattggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtattgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacttatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttggtaacaatctgaccctagctctgctggcatgggctcacttcccttgaagtggtccttaggagcagtccacctggattcttcctgcctgaggctgttctgaccaggtccttccgagagagcaggcgcgggggggtgcggtggtcaggaacgaggagactccactaagttccttgtgttgccttcattttcattcccccaacccccaatgaattttagccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctcagtctgacttggcgatatgtctaagttccccagcccttcccctgctgtgctcttgaaagaagaacttaacaattttagggtaaaaagagaccaacagaccggcacagtggctcaaacctgttgtcctagcactttgggaggctgaggcgggcggatcacctgaggtcaggagtttgagaccggcctggacaatatggcgaaatcccatctccactaaaaatacaaaaattagccggccatggtggcatgcgcctgtaatcccagccactcgggtggctgaggcaggagaattgcctgaacccaggaggcagaggttgcagtgagctaaggtcacgccagtgcatatgcctgggcgacagagcaagactctgtctcaaaaaaaaagaaaaaaaaaaaagaccaacaaccttcccttttcttccgctttccctacagaagacacagaaaagcatttttgcctctagatccttttgtctagggtaaattcttagggtgacaagagtatgcggcaggaagaaggaggagccataaaggaagagaagccagcttgttggcatggggcatagaaaaggacaaaatctaggcatgaaaaggatggataaatactgcaaatattatgttcttacccattcttggaaacgtcagctttcttgcttcctgtgcttccagccgaggtagggcaaaggtgagattgagaaaatagccattcagctcaggaaggcttctaagtaaaggatggatttggatt

SEQ ID NO: 349083 - DNA, 5234 bp, Homo sapiens
ggcacgagtggcggaaaggctgcggccccgcgccagagggccggtggctcctccgggcttctgaggacccgcagggagcgggcctcatcatttctgtctcctgtttctccacttccttctctattggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtattgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacttatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagaggtagggaatttgatgggaccttctttttcttctctaatcctgaagacaaactctaccacgtccttaccccttaacatatttagatattctctctctctctcacccccatcgttcccacagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctcagtctgacttggcgatatgtctaagttccccagcccttcccctgctgtgctcttgaaagaagaacttaacaattttagggtaaaaagagaccaacagaccggcacagtggctcaaacctgttgtcctagcactttgggaggctgaggcgggcggatcacctgaggtcaggagtttgagaccggcctggacaatatggcgaaatcccatctccactaaaaatacaaaaattagccggccatggtggcatgcgcctgtaatcccagccactcgggtggctgaggcaggagaattgcctgaacccaggaggcagaggttgcagtgagctaaggtcacgccagtgcatatgcctgggcgacagagcaagactctgtctcaaaaaaaaagaaaaaaaaaaaagaccaacaaccttcccttttcttccgctttccctacagaagacacagaaaagcatttttgcctctagatccttttgtctagggtaaattcttagggtgacaagagtatgcggcaggaagaaggaggagccataaaggaagagaagccagcttgttggcatggggcatagaaaaggacaaaatctaggcatgaaaaggatggataaatactgcaaatattatgttcttacccattcttggaaacgtcagctttcttgcttcctgtgcttccagccgaggtagggcaaaggtgagattgagaaaatagccattcagctcaggaaggcttctaagtaaaggatggatttggatt

SEQ ID NO: 349084 - DNA, 3162 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349085 - DNA, 2591 bp, Homo sapiens
ggcacgtgcctggaataccagctactcaggaggctgaggcaggagaatcgcttgaacctgggaggtggaggttgcgatgagccaagatctcaccattgcactccagcctgagcaacaagagtgaaactccgtctcaaaaacaaacaaacaaacaaacaaacaaaaaaacagaaaatatagtatattttattgtattttctaggaacagaaagctgaaaaagtgagtcttgtctctattggtaaaagtataccttaaatacattcatacacacactcctaattagcatatttttgattaaatgagaatgtgctttgactttaattcattatgttccttcaacagagaaattggacttgacatttcattctttcaattaccccctcttacaggatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349086 - DNA, 2315 bp, Homo sapiens
cagggcagcccactgtgctaagacactagaacgtacatcaagaagcatccaattctgatttttccctcagagggcttccatttaaagaggaactaaggtgcataagcagataaggatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349087 - DNA, 2138 bp, Homo sapiens
aaatgttttatctccaaaccctggtgtcattcctaaaatgctcatgtaacatgcttcagtatgatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349088 - DNA, 3696 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattggtattaatacatttttatagcatagacactaaatataaatatttaaaactctggtgcagctattaattgtgattttcaatcaatggcagcaacatgggtccattctgggcttccccaaggcaaagccctatgaaggaagcatcttggaggccgactgtgacatactgatcccagctgccagtgagaagcagttgaccaaatccaacgcacccagagtcaaagccaaggtgacaacattatagaaaccagaaccaacattatcaatgtgaatgacgttaggggggtcatagaagagtctgattgagttttctctttctttttagcagctttattggcacatactgcacataccatacagttcccccatttaaggtacataatttaatggcttttagctaccggcacagagttgtgcaaccattaccaaaacaaacgcatctgcctgacactcctgtaaaaaaaaaaaacaagcaaacaaaaaaaaacctagataaatagaaaagtgaaaggtagttttatacacttggcagagaaaaataacctctatttaactttaactgaaactgtgcttctccccacagccccttgttcatatatgcacatctcttgccctcagtggaggggatttgacggtggtgttcgcatttctctatgttcctgactctcttgcagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349089 - DNA, 3479 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaaaacaaaaaaaaaagaacaacgaataaaaagagaaaaaaaaaaaaacaagaccaaaaacacacacacaacacaaacacaaaaaaaaaaaagacggggggggcgcaccgaccagcaaccgccacagggcggccacaaaaaccagcgcaccaccaatataacacacgcggccacccaaagaaggggagataaaaaaaaagcggagagaggagacgaaaaacaaacgggagtaggagagaaaacgagggaagagaagaaatacagggaagaaacaacacactgtggtgggaggaataagagggcaacacacccacagagaa

SEQ ID NO: 349090 - DNA, 2135 bp, Homo sapiens
tgttatgggtaattgttcttcacagggatttggtaatgtgggcctacactctatgagatatttacatcgttttggtgctaaatgtattgctgttggtgagtctgatgggagtatatggaatccagatggtattgacccaaaggaactggaagacttcaaattggtattaatacatttttatagcatagacactaaatataaatatttaaaactctggtgcagctattaattgtgattttcaatcaatggcagcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349091 - DNA, 3457 bp, Homo sapiens
  misc_feature (3449)..(3452): n is a, c, g, or t
  misc_feature (3454)..(3454): n is a, c, g, or t
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaaacttacgtttcttttctgtgtttttacatgtggtagtttctcttttcataagttataatactgcaattggatttctgaaatgtttatagcgaccacctgtataacatttccttccactttattgtgagctgcccagattttattcttgaattgttttttttttttttgttcggtgctttacacgttcagagaaacttcccgagtaacgaactatagaaatgatccctgaaagcatagtctttattctcgaattattttgtattttattaaataatatgaacagctannnnanaaa

SEQ ID NO: 349092 - DNA, 3298 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaatattcatatattttacttattcttatatatattatactaaaactcattgggggtcaccttatcctaattctctcttttttgcgctctaattaaatttcctctgtttgtcttttttataaatcttcagaattgtaaa

SEQ ID NO: 349093 - DNA, 3108 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349094 - DNA, 1742 bp, Homo sapiens
cccgggggagaccagagagacaccagagagtagaaaccagagacccgtgacccgtgagaaaattttacccttagtcttaccccgcccttggaactaaacttccctttttgggttacagttatagtttgggactacttttgattctacttttttttttttttttctgttagcaatatcttgatctcttgttatttttttgtagtgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349095 - DNA, 2981 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagcagtcagttgcttgcttattttttctggatgagtctgggacacactgtaactttaacacattgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349096 - DNA, 2950 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349097 - DNA, 2096 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcggtgagtgtggtgaccccacagttgtacttcacacatgctccctgctctttccttcagacagagctggttagatggatttcatctgcggcatagtctttgtaattagcttgacagtaagtgcgtgacatgtgtgttttgtacctttccttttcattacattctaaaactggagtaagaatcctactgactactaacaaatataaaataaataaatttggtatttttcacgcacgtgttttaacagtgaaggattattatgtattttaattattttaagcttcagagaaataggaagaattgaaaagcaagcattagattgaactatatgggagtccaagagtttgagaccaacctggggaacatagtgagtccccatctctac

SEQ ID NO: 349098 - DNA, 1475 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349099 - DNA, 719 bp, Homo sapiens
actgcattttctctttcatttcagcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaat

SEQ ID NO: 349100 - DNA, 419 bp, Homo sapiens
catgtgttaacatgtattttacttaggagaatcttaattaagttgaaattacttgaaaatagaagtggtggctggacacagtggctcatgcctgtattcccagcactttgggaggccaagacgggtggatcacttgaggccaggagttcgagaccagcctggccaacatggtgaaaccctgtctctactaaaagtagaaaaattaagccgggcgtggtggctcacgcctgtaatcccatcactttgggaggccaaggtgggcagatcacgaggtcaagagatcaagaccatcctggccaacatggtgaaacccggtctccgctaaaaataggaaaattagcagggtgtggtggtacacgcctgtagtcccagctactctggaggctgacgcaggagaatcacttgaacccgggaggtgg

SEQ ID NO: 349101 - DNA, 2440 bp, Homo sapiens
gtttaatcaagacaggatctcactatgttgcccaggcttgtctcaaattcctggactcaagccatcctcctgcctcggcctcccaaagtgctgggattacaggcataagccactgccccggcctagttggaattgttgtttgaggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349102 - DNA, 2588 bp, Homo sapiens
tcttacaatgcatttactgtacagttaggaagcaaagtgttaaatggagaagatacttgtttttattaacattttgagatttagataactacattttaactgaatgtctaaagtgattatcttttgtccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaagtgtgtgatttgggtgggcttttacatcttgcctaccattgcatgaaacattggggtttcttcaaaatgtgtgtgtcatacttctgatgggagaagactggggtcccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349103 - DNA, 3607 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaaggtgacaacattatagaaaccagaaccaacattatcaatgtgaatgacgttaggggggtcatagaagagtctgattgagttttctctttctttttagcagctttattggcacatactgcacataccatacagttcccccatttaaggtacataatttaatggcttttagctaccggcacagagttgtgcaaccattaccaaaacaaacgcatctgcctgacactcctgtaaaaaaaaaaaacaagcaaacaaaaaaaaacctagataaatagaaaagtgaaaggtagttttatacacttggcagagaaaaataacctctatttaactttaactgaaactgtgcttctccccacagccccttgttcatatatgcacatctcttgccctcagtggaggggatttgacggtggtgttcgcatttctctatgttcctgactctcttgcagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349104 - DNA, 3024 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaa

SEQ ID NO: 349105 - DNA, 3720 bp, Homo sapiens
  misc_feature (3372)..(3372): n is a, c, g, or t
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaacttccatattgagactagggactagtgcacagacgtaaatcctctttagtcaggggtaatatctttgctccaaatcaggcccgagcttacttgtctaagactgtgcctttcttggcagagccattcctcctaactgaggcttccatatcacttcggaaattttaacaaaccggaataggctattgggctcatattattgaccctccaaanccgagcatgaaacccttggatgtcttcggtacccaccgaatggccattgacgggcaacatccccccttgccggtctataaaccacccgcttggtattgggaatcaatcccaactgcttcatgaaattttttaaaaccgctcccccacaaattccatcgataacacattggcccctctttccccccactggaaaatcttattggaaaaaggttgcttcgaaataattggttgtaataaaaaaggggttacaacaaaaaaaatttttaaaacccaccttttctcatggggggggggccctctttttttgcgggtaaagaagccccgacaaaacggttctttttgtgttga

SEQ ID NO: 349106 - DNA, 3115 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgagagtcttaactctgtcacccaggctggagtgcagtggtgcaatctccttgatggcaagcttggtggagagggctgaagctgttgctgggggccg

SEQ ID NO: 349107 - DNA, 3400 bp, Homo sapiens
  misc_feature (3392)..(3395): n is a, c, g, or t
  misc_feature (3397)..(3397): n is a, c, g, or t
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccaggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaaacttacgtttcttttctgtgtttttacatgtggtagtttctcttttcataagttataatactgcaattggatttctgaaatgtttatagcgaccacctgtataacatttccttccactttattgtgagctgcccagattttattcttgaattgttttttttttttttgttcggtgctttacacgttcagagaaacttcccgagtaacgaactatagaaatgatccctgaaagcatagtctttattctcgaattattttgtattttattaaataatatgaacagctannnnanaaa

SEQ ID NO: 349108 - DNA, 2528 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagccttggaccaaatggaaataaagctttttgatgca

SEQ ID NO: 349109 - DNA, 1564 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccaggatcttttaacttggaaaggcttggggggaggtggccaagtaattctttacttttggaggtgggc

SEQ ID NO: 349110 - DNA, 1824 bp, Homo sapiens
gcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcaggtaaaaacaaaaacaaaaaaagtttccttaataactgatagacattaagtaaagttttcaatgtttttagaattgtaattttaaaattaagttatctcaaatctcttaaattttagagtggtggttttcagagtaatagatattttgttttttgaaccttggtatgattcatgtaactagaactgatttaagtatctctcaagtacatgtgaaactgttaccaacttcaaccaaactatcaccaaattcaaccaaaatattggttagtattcaaacttgaaattatagctagaagggcaagtctcttaacataattttctaagttttgtaagtatatagaaaggtttacacactgacccaaatttgtttcatgtgttaacatgtattttacttaggagaatcttaattaagttgaaattacttgaaaatagaagtggtggctggacacagtggctcatgcctgtaatcccatcactttgggaggccaaggtgggcagatcacgaggtcaagagatcaagaccatcctggccaacatggtgaaacccggtctccgctaaaaataggaaaattagcagggtgtggtggtacacgcctgtagtcccagctactctggaggcttcggctgaccaggcttcagtgcctgaccaggcttcagtgcctgaccaggcttcagtgccagacc

SEQ ID NO: 349111 - DNA, 2263 bp, Homo sapiens
gggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaacacggtctgaacttgcctctgagaacccgcagggccgtaaacctgaattccgcgggagagaacggcgtccgtttctctcgcgacacttcatggataacgtagatgcttcaagtccagttcggctctcattggctaccgcacgcagtgagggggcggggaaagtagcggcgaggccccgccctcacgcaggagccaatcctgagcaggctaggagacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcggcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaaca

SEQ ID NO: 349112 - DNA, 3276 bp, Homo sapiens
gggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaacacggtctgaacttgcctctgagaacccgcagggccgtaaacctgaattccgcgggagagaacggcgtccgtttctctcgcgacacttcatggataacgtagatgcttcaagtccagttcggctctcattggctaccgcacgcagtgagggggcggggaaagtagcggcgaggccccgccctcacgcaggagccaatcctgagcaggctaggagacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcgggtaaaaaaaaaaattacagagggaagtgtgacagtaggaaaagcactgggttcaagccagaagacctgcctttactgttatggccatcatacctatctcttgattgtgaggaccaaatgagacaatgtacatgaaagcacatattaagctgcaaagtgtcatgctaggtattatttgggggtttaaggataattatctataaagatagcaagcaatcatctatattttaaaatcatttatataaagtcattaggatcatttaggaaagagaggatggaaactaacatttattaaaaactaactataccaggtaccttattacattattttatttaatcatcatgtatccctataagtaatattcttctcttttatagagtaagaaattgagattcaggaatattaatttgcccaggatcatcgaagtggaatgaacatcaaaagcctattccctctgcttggccacttccacctcattttactaagtttccccatgtctgtgttagtaaactaataactaaaagggtctcgcattttaaatagctttttaacccaagagcatgccacatttaaccagaggcccatagaacaaactgaaaattacaacctaaaaggttgtttctaaggttgtattgagaaggaattgagctcttgaatccctagaattccttattaatactttattcttctgttaaaagttttatttttaaaagtttcatacagtgtgtatattggtgtgataatcctacagaaaaatcaagcagttatgttttcttcacagataacacataaaatattaaacagaaagcctatgttattcattggactgaagcttttatgcaataaaccttagttggaccaggagtaaatgtatggtttgatattcagagaatctcattcttagaagcaacaaagtgtagttaacactaacttgttcattcttaaatcagtagtcctctcctccccaaaaagagatcttaaattattttcattttaaagtcatctactaacaacttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaaca

SEQ ID NO: 349113 - DNA, 3382 bp, Homo sapiens
gggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaacacggtctgaacttgcctctgagaacccgcagggccgtaaacctgaattccgcgggagagaacggcgtccgtttctctcgcgacacttcatggataacgtagatgcttcaagtccagttcggctctcattggctaccgcacgcagtgagggggcggggaaagtagcggcgaggccccgccctcacgcaggagccaatcctgagcaggctaggagacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcgggtaaaaaaaaaaattacagagggaagtgtgacagtaggaaaagcactgggttcaagccagaagacctgcctttactgttatggccatcatacctatctcttgattgtgaggaccaaatgagacaatgtacatgaaagcacatattaagctgcaaagtgtcatgctaggtattatttgggggtttaaggataattatctataaagatagcaagcaatcatctatattttaaaatcatttatataaagtcattaggatcatttaggaaagagaggatggaaactaacatttattaaaaactaactataccaggtaccttattacattattttatttaatcatcatgtatccctataagtaatattcttctcttttatagagtaagaaattgagattcaggaatattaatttgcccaggatcatcgaagtggaatgaacatcaaaagcctattccctctgcttggccacttccacctcattttactaagtttccccatgtctgtgttagtaaactaataactaaaagggtctcgcattttaaatagctttttaacccaagagcatgccacatttaaccagaggcccatagaacaaactgaaaattacaacctaaaaggttgtttctaaggttgtattgagaaggaattgagctcttgaatccctagaattccttattaatactttattcttctgttaaaagttttatttttaaaagtttcatacagtgtgtatattggtgtgataatcctacagaaaaatcaagcagttatgttttcttcacagataacacataaaatattaaacagaaagcctatgttattcattggactgaagcttttatgcaataaaccttagttggaccaggagtaaatgtatggtttgatattcagagaatctcattcttagaagcaacaaagtgtagttaacactaacttgttcattcttaaatcagtagtcctctcctccccaaaaagagatcttaaattattttcattttaaagtcatctactaacaagtaagtttttattcaacttaattaaatctaacaccacaagacaattttgttttagttattgttttggtttgagttgagttgaaagatttcttttttttcttctcagcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaaca

SEQ ID NO: 349114 - DNA, 2651 bp, Homo sapiens
gggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaacacggtctgaacttgcctctgagaacccgcagggccgtaaacctgaattccgcgggagagaacggcgtccgtttctctcgcgacacttcatggataacgtagatgcttcaagtccagttcggctctcattggctaccgcacgcagtgagggggcggggaaagtagcggcgaggccccgccctcacgcaggagccaatcctgagcaggctaggagacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttgggtaggcaattctgatgaagatgaggagcaagatgacaaaaatgaagagtggtatcgattgcaagaaaaaaaaatggaaaaagacccaagcagattgcttctttgggctgctgaaaaaaatcggcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaacaaaaaaggcatgaattcattttttacctgtgtatgtctttcttggatccagaacattattcatccagcacgcacttagttatttaacatctactcactcagtctctccagcagcaattttgcattgtctatctagcccctctgtgattgttcccaaagttttgtcttctcaacaccacaacactccaggggaagggaactaaaccagttgctctttacttcagttaaatttttaagatgtccaccaaggcttatctctttcaagccatcctacgtaacccagtcaccctagactaagtaataatgttatttaatcaaagattaaatatttatttttgcttagaacttattagatcatctcagaaaagtcagagataatatatgaactga

SEQ ID NO: 349115 - DNA, 2140 bp, Homo sapiens
gggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaacacggtctgaacttgcctctgagaacccgcagggccgtaaacctgaattccgcgggagagaacggcgtccgtttctctcgcgacacttcatggataacgtagatgcttcaagtccagttcggctctcattggctaccgcacgcagtgagggggcggggaaagtagcggcgaggccccgccctcacgcaggagccaatcctgagcaggctaggagacgaacccggaagtgagatgcaaggcggcgattttcccttctgtcagatcttgatgaacaaagcagtcataattcatctctagaaagatttatatcctggcatttgaaatgctttttatttagaatagtagtaaaaaatggaaaaagaaaaaggaaatgatgatggaataccagaccaagagaattccttggatttttctgaacactttaaccaacttgaattgttggaaacacatggacaccttattcctactggtactcaaagtctttggcttaccacagtgcggagactcctttctgaaaaggccactcacgtgaacactagggatgaagatgagtatacccctcttcatcgagcagcctacagtggacacttagatattgttcaggagctcattgcacagggggccgatgttcatgcagtgactgtggatggctggacgcccctgcacagtgcttgtaagtggaataataccagagtggcttctttcttactgcagcatgatgcagatatcaatgcccaaacaaaaggcctcttgacccccttgcatcttgctgctgggaacagagacagcaaggataccctagaactcctcctgatgaaccgttacgtcaaaccagggctgaaaaacaacttggaagaaactgcatttgatattgccaggaggacaagtatctatcactacctctttgaaattgtggaaggctgtacaaattcttcacctcagtcttaacaattctagtaattttcctaagtttctaaataccagtgcctcctgtgtgtgagatgtattcccataatcaaagttgacgtcaaacatcttactacaaaaattcagtgacattcattataacattcttccaagtgaattgcctgactttgatgtcaaaatgtatttgaaagtaatttgcatatatctttaattatttctgtggagtttgtgatttttttatcagaaataattttaatgtgtgtatacttaaaaacttgacacgggttgtacagaaactggtatttttggtgctgatacaagagaaatgtatttttaaatatcccacatcctggatctttgttgggtatttagtatattgacatatatttttataaggtgaggtaactcagaacttaatttaaaagtcttaaatattctgatacaattcagctgtcttctctaccttaccatagccagttgctttcattttaaaccagagcaagtaacatattagtgacttgaatcttcataagttaaagtaaaaaacagcaaaaaacctagatctttgtcttttagaacacagaccattttcaggaaagcagttagctaagtgtttaattcatgaatattgtatactgcatcccctaccacaatttacacaatcctgtggatagtcctacctcaccctggtcaacctacatgatccttaagctaatggcgaatcacgatgaccttgtagacatgcacacaactatacctttgtccaacagatcataatatatctgctatccaactggttttacctgcctaatcctactgatttgggcactgcttgtatagtctctcaagttcacaggaaatgttgattttctaaggtcctcatttttacagagtatacaggcaaagtgacaggggaaaaggaattagtctaagagtaaggggatgattattatattgaggctaaaaccacaaagtggctcaggctttaaaaaaaaaacactgtggataatgacaaaaagcataagtaaaaatatttgagaaaaataaagtacaagttttgaacaaca

SEQ ID NO: 349116 - DNA, 435 bp, Homo sapiens
ctgagatccctgtggaagatattgtaagaaaaagcacaattttttcttacatattgacatagccctcaagtaggatcatgaaagcgtattcttggtcctaacatacaaaccatccacttttgtggttcttgcaaatcaatatagaaaacaagcattttccaggttggtagctgcataccagatgccagggtcaacgttgatttgcttcattaaggcaccattcttgagcaaaagctgaaactgaagccaatacctgaataaatgtatgacattccacagtcgttctccaagatccatcccacttctatagagcccaaataagcaaattagatagggatgggattggtatcactacacttgcatcttacaaatctttgggaatggcaatagcctctgaagttcctccagcaatgtggtattgcttttggtttacca

SEQ ID NO: 349117 - DNA, 2330 bp, Homo sapiens
agagagagagagagagagagagagagagagagagagagagagagagagagagagagagagagaggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggaatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349118 - DNA, 2953 bp, Homo sapiens
  misc_feature (2363)..(2363): n is a, c, g, or t
agagagagagagagagagagagagagagagagagagagagagagagagagagagagagagagaggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggaatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcaaaaaaaaaaaaaaaaaaaaaaaaaaaaaaaaanaaaaaaaaaaaaaaaaaagagagagagaggacgagcaaaaaaaaaaaaccaaaagaagaaaggagacacaaaaaaaagaagaaacacaaaatagaaaaaaaggggccccaaagaggggagaaaagaaagaggggcaccaaccaacatacaaacaccgagcagggaggacagggagaacacaacacccggctataacacgcggcaggacgcacatactgcgggagagaaagagaagaaccccaacagacaacaactgggggggaaggagcccaacaaccaataatgtgcacacacccacaccacaccacccacaagcgagatacataatctcgaaaccaccatacgaagagagagcaacacaacacacaagccatccgaacgacgaagacaacaaaaggagggataaaaacaaaacatcgaggaccaaaataatactggagcgacagggaagagatgaacaacaagaacgcgccgcacaacaaaggagagaacaaatagaatcaccagcaagacaaaaagttgaacacaccagaaggacacaacaccgtagagcagaaagaaaaaaaagacgaaagagacaaaacgaagga

SEQ ID NO: 349119 - DNA, 1854 bp, Homo sapiens
gtaaactataacgtatcccgttggtgtaccagtgagttcattttactgtaaactaagaataacatacctttttaatactgaaagttgactactcatcaagaaatgtagctagattctttatgtaacacttttgaggggcagtggggacataatgggttgtggaaaatgtgttttaacatttttattttttttttattctacccgagttcattgttgtttgaaccatcctctaaagatttcctttaacctctaaatgttgtgcttttaggttgataacaaatgtaaagcactgaggagggaggaataaagcatacaagttaatttctaattttcgcaagcctgaaccatcctaatctgatagtaggatgtatggcttcttccttttcaccttgtgtgatgtttaatttgagacgatctagccataaaactagtaatcttgaattcctcttgagctggatggtgattagccattgtgaaaacagattatatggaaattgtgcatattgctaaattttaaaacatggatttatcaactgataataaaatatatcttacaagataaccacttgttttttaatgtaaaattgcacaagggcttaagtttcattgcctttcacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacat

SEQ ID NO: 349120 - DNA, 1365 bp, Homo sapiens
ggggtttcaccgtgttagccaggatggtctcgatctcctgacctcatgatctgcccgcctaggcctcccaaagtgctgggattacaggcatgagccaccacacccagcccagacttactttttttaaaataagactaccagaggccgggtgcagtggctcagtttgggaggccaaggtgggaggattgcttgagtccaagagtttaagaccagtctgagcaacatagtgagaccccatttcattaaaaaaaaaaaaagataaaataagactatcatatagagctgtgtaatgtagtgagcctacattacaaaaatatatacaaccacacagagaatatgtaattacaccttgcctatatccataaatgatttgaagcaggtaacacatttgcttttaaatgccatttacaacatagactcttgaatgacatgaatttgaaaatgaagtattttttcagacttaaaacgttgatgtgctaatgtagcttactttaaaaaatgatttccaagtggggaaccaactacattgggaaaagacagtcagattcaaggacagtgtcataaaattgctggttttccttagtcaccctgactttatttttttgagacagagtctcgctctgtcactcaggttggaatgcagtggcgcgatctcggctcaccgcaatctctgcctcccgggttcaagcgattctcctgcctcagcctcccaagtagctgggactacaggcacatgccacagttcccagctaatttttgtaattttagtagagacagggtttcaccatattggtcaggctggtctggaactcctgacctcaggtgatccacctgcctcggcctctcaaagtgctgggattacaggcatgagccatcgtgcccagccactctcactttaatactatgaaaaatgctacttagatttttttctatactgcctacattccaagttattaaagtttaaaaccgtatgaaagcatttatgaagattctgaattgtatttctcattaaaagaaaagaaatgtgagtcatgtcccgaggcttatgtagaggagaaagcagaaggccattgtcagtcattttgaaagttaaaacctccagcacttaatgtgaatttagatcccatttaagagaggattccctcagttttatgggtttgtgctcctctgagcatcctcagggaagtgagaacacaagacttctgttcttctaagcaaaaatcattatcaaatgaatttattaaagagctatcccgagcaaattgcaattgtatgtatgtagctacataggcttccatgggaattgtaaatggctagctgagggcactttcaattgattcagagtaaaacaatctgaggcttgta

SEQ ID NO: 349121 - DNA, 435 bp, Homo sapiens
tttttttttgatgagaagctaagttttattattataattacaaattaattacagagaaactgaagccattcttcatacatgacaaacatacatttcctctgtgtgtacagcacacaagtaatatacacaaatatattccatgtctgaacaaatcctttttaaaactttaaaagctggctgggcacagtggctcacgcctgcaatttcaaacactaagacttaaatatacaacttgatcatacaattatctcaaaacatatgatcaaaaactttggtcaagagcttctttcatgaattcttcaaggacagctatcacatttttggcttcaggcatttcttcatgttccactttaacaatcttcaaaagtatatctccactaccacagttctttaggaacatgtaacatttaaacaaagcataatgattcatttctg

SEQ ID NO: 349122 - DNA, 495 bp, Homo sapiens
ttttgagacagagtctcgctctgtcgcccaggctggagtgcagtggcgcgatctcggctcactgcaagctccacctcctgggttcacgccactctcctgcctcagcctccagagtagctgggactacaggcgcccgccaccatgcccggctaattttttgtattttagtagagacgggctttctcgacaggcttttgcagttgtgggtcgtgtgactctgtgactcaggaggatcttgttcggtgcgaattttggactccgggaggcggcctggacccctccgccagggacagtgtcccctagggactattcagccaccttccgttgttttggtgacgattcaacaagggacttttcttcgagtgcgataggcttattactttcatggagggttggggacagcttcacagtctgtcacccactttttctgtttttatttactttatgtgtgttttgtgtttattttttcgaattggcggtttagtaaagaaccaa

SEQ ID NO: 349123 - DNA, 345 bp, Homo sapiens
  misc_feature (17)..(17): n is a, c, g, or t
  misc_feature (21)..(21): n is a, c, g, or t
ggtactctagaggatcngcanactgggtcgagttcgacaggcttttgcagttgtgggtcgtgtgactctgtgactcaggaggatcttgttcggtgcgaattttggactccgggaggcggcctggacccctccgccagggacagtgtcccctagggactattcagccaccttccgttgttttggtgacgattcaacaagggacttttcttcgagtgcgataggcttattactttcatggagggttggggacagcttcacagtctgtcacccactttttctgtttttatttactttatgtgtgttttgtgtttattttttcgaattggcggtttagtaaagaaccaa

SEQ ID NO: 349124 - DNA, 396 bp, Homo sapiens
ttttattgatttagaattaaaattttgaggctcatactttaattttgtttattgtaaatgcattaactgcctgccttttaaaataagtgacatttgattgcattaaattttgcatttacaaatatgcaatctactaaaaagtctaccacatggcttattttgacccatttgtttggagacttttcattgtttcctttcttttatgctacagatggggacacctgtcacaagctcaagtacagcttcatccaattcagaaagtctgtctgcatcttctaaagctctgtttcctagcacagcacaagtacgcaggaagttgcagtttaaaattgttaaaatggctttataacttaaccctttggaccctacttaaaaaatgaatatttttccaaaaat

SEQ ID NO: 349125 - DNA, 457 bp, Homo sapiens
agaaatcgtccaggtgtggtggttcatgccagtaatctcagcacttgggaggctgaagtaggtagagagagcagttcaattttcttttctccctgcaggtgctgctgtcaagcttgaatgaaaggtatctcatgggtgggcgcgtggctcatgcctgcaatcccagctactcaggaggctgaagtgggaggatcgcttgagcctgggaggcaaaggcttgcagtgagcccagattgcaccactgcactctagcctgggtgacagagtgagaccatgtctcaaaaaaaaaaaaaaaaaaaaccagacacatttcgatagaaacattactgcataaggtattaaaattatgtgttaacatttgatcaccaaaggaaatataagcattattgcattctatcttttagtattgttaaatttctttatttagtcgatgttgtattaaagttaaataaatgca

SEQ ID NO: 349126 - DNA, 448 bp, Homo sapiens
tagtacacgcggatgaattcgactatcgacaattcacgcaacatcctgtaccaacactatgtattccagcaattctgagggtcaaatcaaccagaaagcctcaatcagagcgttccccaccgtacggcgtctcttaacccatgccttcaaacgaggaatgcctcggattggccgctttttttttttttttttttttttgatgagagtagttatatatatacatatacagagaagagcatcttcatacatgacaaacatacatttcctctgtgtgtacagcacacaagtaatatacacaaatatattccatgtctgaacaaatcctttttaaaactttaaaagctggctgggcacagtggctcacgcgtggctcacgcctgtaatcccagcactttgggaggctgaggccgaaggattacctgaggtcaggagttcaagaccagcctgg

SEQ ID NO: 349127 - DNA, 265 bp, Homo sapiens
tttttttttgatgagaagctaagttttattattataattacaaattaattacagagaaactgaagccattcttcatacatgacaaacatacatttcctctgtgtgtacagcacacaagtaatatacacaaatatattccatgtctgaacaaatcctttttaaaactttaaaagctggctgggcacagtggctcacgcactttgggaggccaaggcatgagccaccacacccagcccagacttactttttttaaaataagactacc

SEQ ID NO: 349128 - DNA, 2246 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349129 - DNA, 2915 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcagttttgatatatcattggattctgtctttgagttgtaggttatttcttagctgcatgttttaaactgaatttgcatagagttgtatgttaatgtttcagttaagagaaaaacttaagatacatgagtcattacataatgggtatgaaatctttataatcacccttccaccctctatggtgtcagtacacatcacgtgtcatagatacttaaaatgtaaatgttaacacttttccttcctgctgagatgtttagagcctagtgccagacccattcatttccttttgattatttttgagactcagtactgcatggacctcagaagcttttcaggtgcaaacttctagaagcttaggtgcatgcagtaatagcttcttgtgctgttaatgggttattatatattattctaagtgtaatgctgagaatctaaatgtgtctctgttgggatggttaacagatgaattggcaatttttattatgttcctggaagattacattattcatttgagtaccttctgttattaagcctaggtagccttactgtgcaactttttatttatccttggaaattttgaatgttgtgttcttacagagagcttttctgtagagatgactgctattcaatattttgtgttgcaacctcttaaaataatagctcttgttgacctttt

SEQ ID NO: 349130 - DNA, 2920 bp, Homo sapiens
  misc_feature (357)..(357): n is a, c, g, or t
  misc_feature (361)..(362): n is a, c, g, or t
  misc_feature (364)..(365): n is a, c, g, or t
  misc_feature (367)..(368): n is a, c, g, or t
  misc_feature (371)..(371): n is a, c, g, or t
  misc_feature (374)..(376): n is a, c, g, or t
  misc_feature (379)..(379): n is a, c, g, or t
  misc_feature (381)..(381): n is a, c, g, or t
  misc_feature (606)..(609): n is a, c, g, or t
  misc_feature (678)..(678): n is a, c, g, or t
  misc_feature (681)..(681): n is a, c, g, or t
  misc_feature (683)..(683): n is a, c, g, or t
  misc_feature (687)..(687): n is a, c, g, or t
atcattctctgaagagcatattttattaatcttcaagttcctcagcatattaataataaaaaccttgatatatattatcaacaagtctgactgttatgcccaaagaaaatccagattattttaagtgagtttgttctttttcatctgattcatcatccataacctgttctacgccttctactccggaatataaaactgcagcatgttctgaattccattggaggtatgatgccaccacagccaggcatcccacagcaacaaggaatgagacccccaatgccacctcatggtcagtatggtggtcatcatcaaggcatgccaggataccttcctggtgctatgcccccgtatgggcangganngnnannggngcnnnctnancagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacattattttacatgggnnnnttatttggaataataaagcaggaacttttcctgaagttgcaatttaaaaaaaaaaaaaaaaaaaaaaanaananaaanaaaaaaaaaaaggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349131 - DNA, 2285 bp, Homo sapiens
agagagagagagagagagagagagagagagagagagagagagagagagagagagagagagagaggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349132 - DNA, 2339 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349133 - DNA, 2697 bp, Homo sapiens
  misc_feature (2697)..(2697): n is a, c, g, or t
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaaaaaaaaaaaaaaaaaaaaaggggggggggaaaaaatccccggggggccgcaatgtttttcgccgccccctgctttttttgtaacaaggggccccattggggagggggtttaaaagcggaggggggcgcgggggttacacaaccggtcgggcgtgggagcaacctggccgctgggaccttgtggaggggcccctcttctgtggggcttggcgcttgctgggcacctcctcaagagagtttaatggctggggatacttaccctcacggctgctgctgggacccccggcggatatagggggggcggggagaaatggatctggggttttgtttttggcatacaatgcaagtctctgttatatataaaaaagtcacgagcaaggatgaaagacagcaggaaattatctagaatataaatagaacaagaatgaaagtgcgtaagtaaataaaagcgtccacgagaaaatacaacaataaaggagaggtgataaagataataatcataatatatagaatgaatgaagaatacatatatacaaatataggtgaatgagacatgacan

SEQ ID NO: 349134 - DNA, 2828 bp, Homo sapiens
  misc_feature (2474)..(2474): n is a, c, g, or t
  misc_feature (2476)..(2476): n is a, c, g, or t
  misc_feature (2478)..(2478): n is a, c, g, or t
  misc_feature (2482)..(2483): n is a, c, g, or t
  misc_feature (2485)..(2485): n is a, c, g, or t
  misc_feature (2488)..(2488): n is a, c, g, or t
  misc_feature (2491)..(2491): n is a, c, g, or t
  misc_feature (2496)..(2496): n is a, c, g, or t
  misc_feature (2679)..(2679): n is a, c, g, or t
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaagccctgccataggacaggctgaggctgagtctcagtgttgccctgttcagtctgaggcaagtgggatttattttattccttataggggctttcacagctttatggctgttggatatttatgtccccaaacttgcagcaagtttggtgaaggcccctaaatttaattaaacttaggatttttatactcttttggcagagaaggctctatattaatattcacgtttgactgtggtgttaataaacataagtatttcatatgcaattttatgtaatttgctgtgtgttacataattaacagcttcagtaaagcttgtgttcctatattgaacttcaataaattgacaaaatttgatatttttgattggaggcaagaaatgtttcattcaagttttttactttcacttctaggaaaatcttactggttttattttctccataaactattaaatttaacctcaaggataagtttaatcattggaaatgccactgcactccagcctggncnangagnnanacnccntctcnaaaaaaaaaagaatgttaataacaatacttcattagatagtttcttgttgaagcaatttgtaattcccggaaagttgttagccatgcttcaagtttacaaataggtgaagttttaaggtatctagagtttaagtagttgattggtttgtctggcaaaagtaaatagttgggatgtaagggtanatttttgaaaattactcttaacgttgtaagattttagatgcatgcctttatgcttggtgagcctctgcattcgagtatttagccctgcgcttatttttattccctggaagagagaagggcacagtacctaactctctactcactgcttc

SEQ ID NO: 349135 - DNA, 2839 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctgggtaagaaaattcttttaattgccctgtaggcttgtgcctagtaatgatctttttcaatttggatgttatatgaatgaaatgttactttccattttttgcttctagaaggtatgggctctatatatcttgtctaataaagggatcaaccagtaaatttaaggaatataaatttgcctctgagtaatagatttttgggttttagggtatatgtaagcaaccatctacttcaattgcatttactgtgattaaagtagttggttatttatagatttgcgtttctgagattcagaattatctgtgacactttgtagttgtgacaagaagcagagaaactctgtaaatgatttatttgtcaaagcatcaaaactaaaatgaatatgaggtgcttgtgcccatcacttttacttaaatattgttggatgtgagaggtatacaatacactttcccactgtattttgaaaatcacagttagattttgattttgtcatacattttcacagattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349136 - DNA, 3462 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaaaaaaagaaaaaaagaaaaagtgataagatttgggagtctattccctgggatgttctattaataataaagtgataataaatgaaggttaaagtcaagtgttcaattactacaccaggaaagattgattatttctgaggaaaaggtccatttatttccaaactagtctgtagtggtttagagtaagcattattttatgaagtggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattatttaaaaaaaaaaa

SEQ ID NO: 349137 - DNA, 1920 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggtaagttgcttttagttttctacgagcagcatttgatttaaagccattatagcagttcgtccctttaaaataagtgttcatttgtactcagatggtctgtgatctggtttaatgctcactaagtggtttttgccattctgattcttaagaaatcataaaatacttaaagtggacagatattgcatgttttggtcttagatggtttctctccccttcctccagactgtttctaaaagaagacagtaagtcaggttcttaactctcttaaaaatcattttagttaaacataagtttgcatatgttaattgaataaacgttaagtgtgaagtagaatctgcagatcccttaagtcccatataaatgaatgaattttgatacaaagttaatgtttagaatgttgataatggccaggtgtggtggctcacgcctataattccagcactttgggaggccaagacaggcagatcacttgatcaggagttcaagaccagcctggccaacatggtgaaacctcatccatacaaaaattagcagtgtgtagtggcgggcacctgtaatcccagctactcgggaggctgaggcgggatcatcagttgaacttgggaggcggaggttgcgttgagccaagattgcaccactgcactccagcctgggcaacagagcaagactccatctcaaaaaaaaa

SEQ ID NO: 349138 - DNA, 1833 bp, Homo sapiens
  misc_feature (109)..(109): n is a, c, g, or t
tgtggctgaaatgaagttgaggctgcagagtcgtcatcatcatattcatcagaatcatcttgttgcttctttttttgactttcttgtgtcttctgttcaagaaggcgtncgctttcatccatgtctttttcaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349139 - DNA, 2279 bp, Homo sapiens
ttgtatcgaagtatccgcattctcttccctctaactctttaatatttgttattattttgattgaaattcttgcttgtaggcatacctccattaatgccaggtgttcctcctctgatgccaggaatgccaccagttatgccaggcatgccacctgggtaagaaaattcttttaattgccctgtaggcttgtgcctagtaatgatctttttcaatttggatgttatatgaatgaaatgttactttccattttttgcttctagaaggtatgggctctatatatcttgtctaataaagggatcaaccagtaaatttaaggaatataaatttgcctctgagtaatagatttttgggttttagggtatatgtaagcaaccatctacttcaattgcatttactgtgattaaagtagttggttatttatagatttgcgtttctgagattcagaattatctgtgacactttgtagttgtgacaagaagcagagaaactctgtaaatgatttatttgtcaaagcatcaaaactaaaatgaatatgaggtgcttgtgcccatcacttttacttaaatattgttggatgtgagaggtatacaatacactttcccactgtattttgaaaatcacagttagattttgattttgtcatacattttcacagattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349140 - DNA, 1573 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggtaaggtgaaaatcctgaaaaggagtgcacttatatttaaagataaagtacagttgtttacagaagtctttgaaattttcataggtcaatttttttgtttataatatttttaatattatttattaaatatactaaaaggtggcttatccacttccatgtttacacactgatttcctctacccataaaaggttgaacggagccaaagttagtatgttactttttcatagctgtgaaccctatttattcttagtttttttttttttttttttaagctaatgaaagtttagtatctggagcgtttagaagttttcctttactgactaaactgaatggaaggacaccaaagtcaaagattagcattcttaagacggtagcaaatcatttgtcaggctctgcctctagtacggaacagtgatgagctacaatgccgcacttgtgcttcttttttcaaagcttttaaaagtcttttttccagagcataagtgaaagatgcttctgttctatatggtatacacatgatggttaacacctttgctttttttcctagtttcattgagaagcagattcagatttaatttat

SEQ ID NO: 349141 - DNA, 1484 bp, Homo sapiens
atataaggcctgtcgcaacaatcagtcttcaaattttggacccatgaagggaggaaattttggaggcagcaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349142 - DNA, 1558 bp, Homo sapiens
ttttattgatttagaattaaaattttgaggctcatactttaattttgtttattgtaaatgcattaactgcctgccttttaaaataagtgacatttgattgcattaaattttgcatttacaaatatgcaatctactaaaaagtctaccacatggcttattttgacccatttgtttggagacttttcattgtttcctttcttttatgctacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349143 - DNA, 1380 bp, Homo sapiens
cccgggaggcggaggttgtggtgagctgagaccaggccattgcactccagcctggacaatgagtgaaaccccgtctcaaaaaaaaaaagaatgttaataacaatacttcattagatagtttcttgttgaagcaatttgtaattcccggaaagttgttagccatgcttcaagtttacaaataggtgaagttttaaggtatctagagtttaagtagttggattggtttgtctggcaaaagtaaatagttgggatgtaagggtaaatttttgaaaattactcttaacgttgtaagattttagatgcatgcctttatgcttggtgagcctctgcattcgagtatttagcccttgcgcttatttttattcccaggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349144 - DNA, 1141 bp, Homo sapiens
atcattctctgaagagcatattttattaatcttcaagttcctcagcatattaataataaaaaccttgatatatattatcaacaagtctgactgttatgcccaaagaaaatccagattattttaagtgagtttgttctttttcatctgattcatcatccataacctgttctacgccttctactccggaatataaaactgcagcatgttctgaattccattggaggtatgatgccaccacagccaggcatcccacagcaacaaggaatgagacccccaatgccacctcatggtcagtatggtggtcatcatcaaggcatgccaggataccttcctggtgcttatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349145 - DNA, 1051 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggaatgatgccaatgggtggaatgatgccacctggaccaggaataccacctctgatgcctggaatgccaccaggtatgcccccacctgttccacgtcctggaattcctccaatgactcaagcacaggggtcagcggcggatcttatagacactgacacagaagtgtcgtgccaagctcagtatagcctttccaggggaagtcaggaggccgccggggcataacctaaagactgggaatgaacccaagaaccggacgacgcaaataaaaggggaacggaaaagaggcacaaggggcgcaaaaggaagaaaccgagacgggacaagaggtgaggcgcggt

SEQ ID NO: 349146 - DNA, 628 bp, Homo sapiens
accaacttaagtcgggcccgctagtaagcctctacctgcacgacaacacatcatgacacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349147 - DNA, 3918 bp, Homo sapiens
ggaatttcatgtatacggttattgacaaactgcaatagggttagtagacctgtttcagaaattatgtgaagctttatttgcattttatgcaaagaaggttgatactttgtagcaaggttttttgctctctgtataggtctgatgggcaaaaatggaacttttaaatatgggatagaattctaattaaaaattaattgaaagtgttaggcattggcagataaaacttaagctcatgagttcctgagtttgtagctataggctcagaggtggtgtacccatttaatatatttgaagtgtaatttttgcatgcatccaaacgtaattaagcttctagaaaataccttttttctaaatgcttctggggtccatagtgtggttgaattatgagtggagcaaattatattcatataattaactctgactcaaccttccttaagtagtagatgaagttgagtcaaagtggatgccaactgccctcacagaagacaacttttgggacttgataattcaggcaggcattgtgattgtcataattaaggaagctgtaaggttagtagggctggcaactttggctctaccttacatccaccccttttagaaaaacaagaaaacattttgtctggcactagtttctgttgtataagttttcatactgtttaacaagaccacagcaggtaaggattaatttttgagtggctgctggaattacttgatttgaatacttagtattttagtagtgtctcacacatttgccattaggtatgaataaaatattcctactgtactcctattccactaagttacattttgaacttagactcaccttaattaaacttaattaattggggagggggattccccaacaaaaagaagtacgggctcagagtggaattgtagtggacaatagttaaaaacaaagctgctccttttgcttgcttgatcattgggatttttaaaaaaaaaaattttaatgcatgtcttttaaattaattgggaactgtttttctaaaattaaaattttcttcttcctatagccctgccataggacaggctgaggctgagtctcagtgttgccctgttcagtctgagcagcagaatttcagcatttgctacttactggtagagaagaaaaatcccacagccctgccagtacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaaaaaaagaaaaaaagaaaaagtgataagatttgggagtctattccctgggatgttctattaataataaagtgataataaatgaaggttaaagtcaagtgttcaattactacaccaggaaagattgattatttctgaggaaaaggtccatttatttccaaactagtctgtagtggtttagagtaagcattattttatgaagtggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattatttaaaaaaaaaaa

SEQ ID NO: 349148 - DNA, 3382 bp, Homo sapiens
gtaaactataacgtatcccgttggtgtaccagtgagttcattttactgtaaactaagaataacatacctttttaatactgaaagttgactactcatcaagaaatgtagctagattctttatgtaacacttttgaggggcagtggggacataatgggttgtggaaaatgtgttttaacatttttattttttttttattctacccgagttcattgttgtttgaaccatcctctaaagatttcctttaacctctaaatgttgtgcttttaggttgataacaaatgtaaagcactgaggagggaggaataaagcatacaagttaatttctaattttcgcaagcctgaaccatcctaatctgatagtaggatgtatggcttcttccttttcaccttgtgtgatgtttaatttgagacgatctagccataaaactagtaatcttgaattcctcttgagctggatggtgattagccattgtgaaaacagattatatggaaattgtgcatattgctaaattttaaaacatggatttatcaactgataataaaatatatcttacaagataaccacttgttttttaatgtaaaattgcacaagggcttaagtttcattgcctttcacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaaaaaaagaaaaaaagaaaaagtgataagatttgggagtctattccctgggatgttctattaataataaagtgataataaatgaaggttaaagtcaagtgttcaattactacaccaggaaagattgattatttctgaggaaaaggtccatttatttccaaactagtctgtagtggtttagagtaagcattattttatgaagtggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattatttaaaaaaaaaaa

SEQ ID NO: 349149 - DNA, 3396 bp, Homo sapiens
  misc_feature (36)..(36): n is a, c, g, or t
  misc_feature (151)..(151): n is a, c, g, or t
  misc_feature (165)..(165): n is a, c, g, or t
  misc_feature (180)..(180): n is a, c, g, or t
ctgtgcaaactctctggattttgcatcaagagcatncatgtaacttctgtagtcctgtaacagtacttcatgaacttctattgcagcagcaatgtgcattgctgtgggaaaagtcgtctttttctccaaaaaatttttgtttcccctttcntttcagaaaggggnccttttaaaagggcntttgggttttccccttcccccaaaacccacaacccaaattcttctggcccccattaggtatgaataaaatattcctactgtactcctattccactaagttacattttgaacttagactcaccttaattaaacttaattaattggggagggggattccccaacaaaaagaagtacgggctcagagtggaattgtagtggacaatagttaaaaacaaagctgctccttttgcttgcttgatcattgggatttttaaaaaaaaaaattttaatgcatgtcttttaaattaattgggaactgtttttctaaaattaaaattttcttcttcctatagccctgccataggacaggctgaggctgagtctcagtgttgccctgttcagtctgagcagcagaatttcagcatttgctacttactggtagagaagaaaaatcccacagccctgccagtacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaaaaaaagaaaaaaagaaaaagtgataagatttgggagtctattccctgggatgttctattaataataaagtgataataaatgaaggttaaagtcaagtgttcaattactacaccaggaaagattgattatttctgaggaaaaggtccatttatttccaaactagtctgtagtggtttagagtaagcattattttatgaagtggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattatttaaaaaaaaaaa

SEQ ID NO: 349150 - DNA, 3440 bp, Homo sapiens
  misc_feature (357)..(357): n is a, c, g, or t
  misc_feature (361)..(362): n is a, c, g, or t
  misc_feature (364)..(365): n is a, c, g, or t
  misc_feature (367)..(368): n is a, c, g, or t
  misc_feature (371)..(371): n is a, c, g, or t
  misc_feature (374)..(376): n is a, c, g, or t
  misc_feature (379)..(379): n is a, c, g, or t
  misc_feature (381)..(381): n is a, c, g, or t
atcattctctgaagagcatattttattaatcttcaagttcctcagcatattaataataaaaaccttgatatatattatcaacaagtctgactgttatgcccaaagaaaatccagattattttaagtgagtttgttctttttcatctgattcatcatccataacctgttctacgccttctactccggaatataaaactgcagcatgttctgaattccattggaggtatgatgccaccacagccaggcatcccacagcaacaaggaatgagacccccaatgccacctcatggtcagtatggtggtcatcatcaaggcatgccaggataccttcctggtgctatgcccccgtatgggcangganngnnannggngcnnnctnancagggtgggcctcctcgacctccgatgggaatgagacctcctgtaatgtcgcaaggtggccgttactgatcttacttcatccagtctaataggtttttagaagtgaagtatagtaaatttggttcgttaaattgtgaaggcgctggaattacatgaacataccaccctagtaaagccctgccataggacaggctgaggctgagtctcagtgttgccctgttcagtctgagcagcagaatttcagcatttgctacttactggtagagaagaaaaatcccacagccctgccagtacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaaaaaaagaaaaaaagaaaaagtgataagatttgggagtctattccctgggatgttctattaataataaagtgataataaatgaaggttaaagtcaagtgttcaattactacaccaggaaagattgattatttctgaggaaaaggtccatttatttccaaactagtctgtagtggtttagagtaagcattattttatgaagtggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattatttaaaaaaaaaaa

SEQ ID NO: 349151 - DNA, 1890 bp, Homo sapiens
  misc_feature (1536)..(1536): n is a, c, g, or t
  misc_feature (1538)..(1538): n is a, c, g, or t
  misc_feature (1540)..(1540): n is a, c, g, or t
  misc_feature (1544)..(1545): n is a, c, g, or t
  misc_feature (1547)..(1547): n is a, c, g, or t
  misc_feature (1550)..(1550): n is a, c, g, or t
  misc_feature (1553)..(1553): n is a, c, g, or t
  misc_feature (1558)..(1558): n is a, c, g, or t
  misc_feature (1741)..(1741): n is a, c, g, or t
ggaatttcatgtatacggttattgacaaactgcaatagggttagtagacctgtttcagaaattatgtgaagctttatttgcattttatgcaaagaaggttgatactttgtagcaaggttttttgctctctgtataggtctgatgggcaaaaatggaacttttaaatatgggatagaattctaattaaaaattaattgaaagtgttaggcattggcagataaaacttaagctcatgagttcctgagtttgtagctataggctcagaggtggtgtacccatttaatatatttgaagtgtaatttttgcatgcatccaaacgtaattaagcttctagaaaataccttttttctaaatgcttctggggtccatagtgtggttgaattatgagtggagcaaattatattcatataattaactctgactcaaccttccttaagtagtagatgaagttgagtcaaagtggatgccaactgccctcacagaagacaacttttgggacttgataattcaggcaggcattgtgattgtcataattaaggaagctgtaaggttagtagggctggcaactttggctctaccttacatccaccccttttagaaaaacaagaaaacattttgtctggcactagtttctgttgtataagttttcatactgtttaacaagaccacagcaggtaaggattaatttttgagtggctgctggaattacttgatttgaatacttagtattttagtagtgtctcacacatttgccattaggtatgaataaaatattcctactgtactcctattccactaagttacattttgaacttagactcaccttaattaaacttaattaattggggagggggattccccaacaaaaagaagtacgggctcagagtggaattgtagtggacaatagttaaaaacaaagctgctccttttgcttgcttgatcattgggatttttaaaaaaaaaaattttaatgcatgtcttttaaattaattgggaactgtttttctaaaattaaaattttcttcttcctatagccctgccataggacaggctgaggctgagtctcagtgttgccctgttcagtctgaggcaagtgggatttattttattccttataggggctttcacagctttatggctgttggatatttatgtccccaaacttgcagcaagtttggtgaaggcccctaaatttaattaaacttaggatttttatactcttttggcagagaaggctctatattaatattcacgtttgactgtggtgttaataaacataagtatttcatatgcaattttatgtaatttgctgtgtgttacataattaacagcttcagtaaagcttgtgttcctatattgaacttcaataaattgacaaaatttgatatttttgattggaggcaagaaatgtttcattcaagttttttactttcacttctaggaaaatcttactggttttattttctccataaactattaaatttaacctcaaggataagtttaatcattggaaatgccactgcactccagcctggncnangagnnanacnccntctcnaaaaaaaaaagaatgttaataacaatacttcattagatagtttcttgttgaagcaatttgtaattcccggaaagttgttagccatgcttcaagtttacaaataggtgaagttttaaggtatctagagtttaagtagttgattggtttgtctggcaaaagtaaatagttgggatgtaagggtanatttttgaaaattactcttaacgttgtaagattttagatgcatgcctttatgcttggtgagcctctgcattcgagtatttagccctgcgcttatttttattccctggaagagagaagggcacagtacctaactctctactcactgcttc

SEQ ID NO: 349152 - DNA, 633 bp, Homo sapiens
tttttttttgatgagaagctaagttttattattataattacaaattaattacagagaaactgaagccattcttcatacatgacaaacatacatttcctctgtgtgtacagcacacaagtaatatacacaaatatattccatgtctgaacaaatcctttttaaaactttaaaagctggctgggcacagtggctcacgcctgtaatcccggcactttgggaggccaaggcgggtggatcacaaggtgagaagatcgagaccatcctggccaacatggtgaaaccccgtctctactaaaaatacaaaaaattagccatgcatggtggcacatgcctgtagtcccagctactggggaggctgaggaaggagaatcacttgaacctgggaggcagaggttgcagtgagcccagattgcaccactgcactctagcctgggtgacagagtgagaccatgtctcaaaaaaaaaaaaaaaaaaaaccagacacatttcgatagaaacattactgcataaggtattaaaattatgtgttaacatttgatcaccaaaggaaatataagcattattgcattctatcttttagtattgttaaatttctttatttagtcgatgttgtattaaagttaaataaatgca

SEQ ID NO: 349153 - DNA, 843 bp, Homo sapiens
  misc_feature (386)..(389): n is a, c, g, or t
  misc_feature (723)..(723): n is a, c, g, or t
  misc_feature (821)..(821): n is a, c, g, or t
cagagtccaaacagtgctcagagtccaaacagtgcccagagtccaaacagtgcccagagtccaaacagggctcagagtccaaacagtgcccagagtccaaacagtgcccaaagtccaaacagtgctcagagtccaaacagtgcccagagtccaaacagtgcccagagtccaaacagtgccctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacattattttacatgggnnnnttatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaacggctttaaggcgccctnatgctgcccggcgttctgctatttcgccaccctgttcttgcccctttcctggtccccttgccttctttggctctttttggtgggcttccttccccccnctttctatcgcgcacactacaa

SEQ ID NO: 349154 - DNA, 1242 bp, Homo sapiens
  misc_feature (357)..(357): n is a, c, g, or t
  misc_feature (361)..(362): n is a, c, g, or t
  misc_feature (364)..(365): n is a, c, g, or t
  misc_feature (367)..(368): n is a, c, g, or t
  misc_feature (371)..(371): n is a, c, g, or t
  misc_feature (374)..(376): n is a, c, g, or t
  misc_feature (379)..(379): n is a, c, g, or t
  misc_feature (381)..(381): n is a, c, g, or t
atcattctctgaagagcatattttattaatcttcaagttcctcagcatattaataataaaaaccttgatatatattatcaacaagtctgactgttatgcccaaagaaaatccagattattttaagtgagtttgttctttttcatctgattcatcatccataacctgttctacgccttctactccggaatataaaactgcagcatgttctgaattccattggaggtatgatgccaccacagccaggcatcccacagcaacaaggaatgagacccccaatgccacctcatggtcagtatggtggtcatcatcaaggcatgccaggataccttcctggtgctatgcccccgtatgggcangganngnnannggngcnnnctnancagggtgggcctcctcgacctccgatgggaatgagacctcctgtaatgtcgcaaggtggccgttactgatcttacttcatccagtctaataggtttttagaagtgaagtatagtaaatttggttcgttaaattgtgaaggcgctggaattacatgaacataccaccctagtaaagccctgccataggacaggctgaggctgagtctcagtgttgccctgttcagtctgagcagcagaatttcagcatttgctacttactggtagagaagaaaaatcccacagccctgccagtacagtttaatctgtatatgaaatggtgtagatacagtggaaatggttttccttaaaaccatctctttaaagctgcctttctggttgctgctgtcaagcttgaatgaaaggtatctcatgggtgggcgcgtggctcatgcctgcaatcccagcacttcgggaggccaagacaggcagatcgcttgagctcaagagtttgagaccagcctggacaaaaccccatccctgtaaaaaatacaaaaattagctgggtgtggtggcgcacgcttatagtcccagctactcaggaggctgaagtgggaggatcgcttgagcctgggaggcaaaggcttgcagtgagcccagattgcaccactgcactctagcctgggtgacagagtgagaccatgtctcaaaaaaaaaaaaaaaaaaaaccagacacatttcgatagaaacattactgcataaggtattaaaattatgtgttaacatttgatcaccaaaggaaatataagcattattgcattctatcttttagtattgttaaatttctttatttagtcgatgttgtattaaagttaaataaatgca

SEQ ID NO: 349155 - DNA, 585 bp, Homo sapiens
tagtacacgcggatgaattcgactatcgacaattcacgcaacatcctgtaccaacactatgtattccagcaattctgagggtcaaatcaaccagaaagcctcaatcagagcgttccccaccgtacggcgtctcttaacccatgccttcaaacgaggaatgcctcggattggccgctttttttttttttttttttttttgatgagagtagttatatatatacatatacagagaagagcatcttcatacatgacaaacatacatttcctctgtgtgtacagcacacaagtaatatacacaaatatattccatgtctgaacaaatcctttttaaaactttaaaagctggctgggcacagtggctcacgcactcaggatttgcatattgacttaaaatctgactttatcatccatgccgttatcaactagacaaaaaaatgtatcaagcacccacaggatgcacagatctatctctgaactggtgtagtggtattaatctgttctaagactagaattacatttttttttttaagaagctacagtccactgaaaaggaagtattatggtttttctgagaagaaaagttgc

SEQ ID NO: 349156 - DNA, 215 bp, Homo sapiens
tcagtaaagcttgtgttcctatattgaacttcaataaattgacaaaatttgatatttttgattggaggcaagaaatgtttcattcaagttttttactttcacttctaggaaaatcttactggttttattttctccataaactattaaatttaacctcaaggataagtttaatcattggaaatgccactggatactgaaatgtgccttctcttttt

SEQ ID NO: 349157 - DNA, 2869 bp, Homo sapiens
  misc_feature (2279)..(2279): n is a, c, g, or t
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcaaaaaaaaaaaaaaaaaaaaaaaaaaaaaaaaanaaaaaaaaaaaaaaaaaagagagagagaggacgagcaaaaaaaaaaaaccaaaagaagaaaggagacacaaaaaaaagaagaaacacaaaatagaaaaaaaggggccccaaagaggggagaaaagaaagaggggcaccaaccaacatacaaacaccgagcagggaggacagggagaacacaacacccggctataacacgcggcaggacgcacatactgcgggagagaaagagaagaaccccaacagacaacaactgggggggaaggagcccaacaaccaataatgtgcacacacccacaccacaccacccacaagcgagatacataatctcgaaaccaccatacgaagagagagcaacacaacacacaagccatccgaacgacgaagacaacaaaaggagggataaaaacaaaacatcgaggaccaaaataatactggagcgacagggaagagatgaacaacaagaacgcgccgcacaacaaaggagagaacaaatagaatcaccagcaagacaaaaagttgaacacaccagaaggacacaacaccgtagagcagaaagaaaaaaaagacgaaagagacaaaacgaagga

SEQ ID NO: 349158 - DNA, 2379 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcaaaaataacaagacaacgaaaaacacaaagagaccacaaggcgagaaaacaaacgcagagaacaggatagaaccaaaaagaggcccaacagcataaaaaaggaaaaacggggcgggggaaaaacgagaagcaga

SEQ ID NO: 349159 - DNA, 2855 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcagttttgatatatcattggattctgtctttgagttgtaggttatttcttagctgcatgttttaaactgaatttgcatagagttgtatgttaatgtttcagttaagagaaaaacttaagatacatgagtcattacataatgggtatgaaatctttataatcacccttccaccctctatggtgtcagtacacatcacgtgtcatagatacttaaaatgtaaatgttaacacttttccttcctgctgagatgtttagagcctagtgccagacccattcatttccttttgattatttttgagactcagtaatagcttcttgtgctgttaatgggttattatatattattctaagtgtaatgctgagaatctaaatgtgtctctgttgggatggttaacagatgaattggcaatttttattatgttcctggaagattacattattcatttgagtaccttctgttattaagcctaggtagccttactgtgcaactttttatttatccttggaaattttgaatgttgtgttcttacagagagcttttctgtagagatgactgctattcaatattttgtgttgcaacctcttaaaataatagctcttgttgacctttt

SEQ ID NO: 349160 - DNA, 2700 bp, Homo sapiens
  misc_feature (386)..(389): n is a, c, g, or t
  misc_feature (458)..(458): n is a, c, g, or t
  misc_feature (461)..(461): n is a, c, g, or t
  misc_feature (463)..(463): n is a, c, g, or t
  misc_feature (467)..(467): n is a, c, g, or t
cagagtccaaacagtgctcagagtccaaacagtgcccagagtccaaacagtgcccagagtccaaacagggctcagagtccaaacagtgcccagagtccaaacagtgcccaaagtccaaacagtgctcagagtccaaacagtgcccagagtccaaacagtgcccagagtccaaacagtgccctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacattattttacatgggnnnnttatttggaataataaagcaggaacttttcctgaagttgcaatttaaaaaaaaaaaaaaaaaaaaaaanaananaaanaaaaaaaaaaaggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349161 - DNA, 4856 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaagccctgccataggacaggctgaggctgagtctcagtgttgccctgttcagtctgagcagcagaatttcagcatttgctacttactggtagagaagaaaaatcccacagccctgccagtacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaaaagtgagcaataattattgcatctcttttgcgacttcatgtagatgtgattaacattttttacaaatttgcctgcataaagattaaattggaacataccttactcctttgtctggtttttttattttgtatggtgctttaaatactaattttatatttcaagctttttgcagggtagaaataagtggctgttaaagaaaatatcttcaagaaggattatttcagtgtccctttttaaaactcgatgatggctttcagtttatttaagtcttctgtttttcagctccagttaaaactgacaataggcagctatcaaaaatggaaaaaatcttgtgctctttctggaatattagaggaatcagttaataatagtaaagtggtattaacccaatacttgatttgcagtttttaaagcagtttttaaattgagagaaaaggggctgggcccagctgaggcgggtggatctcctgaggtcaggagtttgagaccagcctggccaacatagtgaaaccccgtctctactaaaaatacaaaaatcagccgggtgtggtgggacgtgcctgtaaccccagctactctggaggctgaggcaggaaaatcgcttgaacccagggggaggaggttgcagtgagccgagatggcgccgttgcactccagcttgggtgacagagcgagactccgtctcaaaaaaaaaaagaaaaaaagaaaaagtgataagatttgggagtctattccctgggatgttctattaataataaagtgataataaatgaaggttaaagtcaagtgttcaattactacaccaggaaagattgattatttctgaggaaaaggtccatttatttccaaactagtctgtagtggtttagagtaagcattattttatgaagtggtacaagattgcaaaggttagtaaagggacctgtctgtcaggtcaatcttcggtcttcacttttactggcaagggattatgtgaagagtaagtcatacaagggatatgattgtaaggaggtcctgaacaaagcatgataaatgttagtccatgtgtattattaaatggtctaaagaaaaatcatgactgatcgcataatttttaatgtaagtaaatgagctcactaagggtaattaaatactagcttttaaaatttaaagttctcacgaatattagtgcatcttgtcactttgatttgtcacctggttaaatagctggaagcttgtgcaaatgaaaaatgaaatggaagactacatttgtatatatatctgtataatttttgtttactagtaggttcagagagagatctgagatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattatttaaaaaaaaaaa

SEQ ID NO: 349162 - DNA, 3289 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaagccctgccataggacaggctgaggctgagtctcagtgttgccctgttcagtctgagcagcagaatttcagcatttgctacttactggtagagaagaaaaatcccacagccctgccagtacagtttaatctgtatatgaaatggtgtagatacagtggaaatggttttccttaaaaccatctctttaaagctgcctttctggtgagtactgttttatacttttatatattataattttatcttctaaaattaactgaaataggacactttgattaaagaggtgagcactctgaatttctacatctttggatattacttgaatcaagaatattagaaaattattttaccacctggcatttcccttttaatttgctagttcacttttttctgaccttcacttaacagactataaatacaaaaactttgaacacataaattatttcattttggtgagatggaataaatgtttaaaattagtatttaagaaagttcttaaacattttttttagttggcagccaaaagatttttcttagtgctttggagacattgcataggtgtaaaattaagataccagaacttcattctgttcttgttgaagctgttgttgtggtgattcatgagcagtaagctggagttagagtggaagaagggtttaccaaaattcttcctgcagactagttgcttacagggtttctttgagaggcttaaaaatttcaaaagtattatttaagccactctaaccctgcatgaaaaattggagttagaaatactgatttctgagaccacgtataccagtgaaaattagcttctgagtaaatttctaatttatgccctgctttatttagcctcgctatatgtaacacatggattattttttccctctagtttttaactatatcctagattaaaaccagcatatgctaagaatgtttttacattctgtttcctcctgtgatctttctgaaccaataataaacagtcaactgtgatgctttttagtatgaacaatgatagttttctaaaatctgaaaatcaatacctgagtatgtggtcgtcaagcacgcgcgtgcttcaccacgacgtaaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagacaagtaggttcattgctatagcataacacaaaatttgcatatcgtggttagaagca

SEQ ID NO: 349163 - DNA, 2493 bp, Homo sapiens
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaagccctgccataggacaggctgaggctgagtctcagtgttgccctgttcagtctgagcagcagaatttcagcatttgctacttactggtagagaagaaaaatcccacagccctgccagtacaggttagtttaatctgtaagtacctgatgttcctatttttttcaaacatatccatataactcacacaaggaagaaagctgtgcggttacttaaatgttagtataactaataatagatccattggacactttaaacactcagtacttgggccaaagtagatctaggtttgctaaccccagttgtaataaaggtgtaatactgctcctttgttatctccttgtggttcaacctaagtagatacattgtacataaaaggaaaagacagtttcagttggctatgcccttgttgatagatgatatggagtccagggctttgggtccagggtcttttacttaagctatttcatggtggttctctcattcaccttttaactttttacattatgaatcaacctaagaaaa

SEQ ID NO: 349164 - DNA, 2171 bp, Homo sapiens
  misc_feature (2171)..(2171): n is a, c, g, or t
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaataaatgtccaatagttcctggtatgtggggggtggctggagaggaatgatgatagaggaggaaagtacttgtagtgtgactttcctcagagtcaagagaaggaagtgcttgcagcaataaaagtatttaaatataaactgaagaacacctctggttcttgtttttggtagatggagaaacccagagcagagctgaagaggtgtcatctgctctccagatggagtcagctgacaactcagaagcagaaaccaggtcttctgactctgggcaaatgttagatgctccctttagtagcaggaagacctgggtggaaatcctgatttggagtgtggtttgttgactactcccgagatcctgtaan

SEQ ID NO: 349165 - DNA, 2716 bp, Homo sapiens
  misc_feature (357)..(357): n is a, c, g, or t
  misc_feature (361)..(362): n is a, c, g, or t
  misc_feature (364)..(365): n is a, c, g, or t
  misc_feature (367)..(368): n is a, c, g, or t
  misc_feature (371)..(371): n is a, c, g, or t
  misc_feature (374)..(376): n is a, c, g, or t
  misc_feature (379)..(379): n is a, c, g, or t
  misc_feature (381)..(381): n is a, c, g, or t
  misc_feature (606)..(609): n is a, c, g, or t
  misc_feature (678)..(678): n is a, c, g, or t
  misc_feature (681)..(681): n is a, c, g, or t
  misc_feature (683)..(683): n is a, c, g, or t
  misc_feature (687)..(687): n is a, c, g, or t
atcattctctgaagagcatattttattaatcttcaagttcctcagcatattaataataaaaaccttgatatatattatcaacaagtctgactgttatgcccaaagaaaatccagattattttaagtgagtttgttctttttcatctgattcatcatccataacctgttctacgccttctactccggaatataaaactgcagcatgttctgaattccattggaggtatgatgccaccacagccaggcatcccacagcaacaaggaatgagacccccaatgccacctcatggtcagtatggtggtcatcatcaaggcatgccaggataccttcctggtgctatgcccccgtatgggcangganngnnannggngcnnnctnancagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacattattttacatgggnnnnttatttggaataataaagcaggaacttttcctgaagttgcaatttaaaaaaaaaaaaaaaaaaaaaaanaananaaanaaaaaaaaaaaggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349166 - DNA, 1779 bp, Homo sapiens
ttgtatcgaagtatccgcattctcttccctctaactctttaatatttgttattattttgattgaaattcttgcttgtaggcatacctccattaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349167 - DNA, 1764 bp, Homo sapiens
gttttagacaatttattttgataggattgttacagtgtgttgtgtgttctttcagctttgattcatttcagtattagaggtcagattcaagtcttctatctagtgttgtttcaggctttagccagaatattttttaatggtttatgctgttcattaacttactgtttcttgaaatttgctttctaataaatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349168 - DNA, 2352 bp, Homo sapiens
  misc_feature (357)..(357): n is a, c, g, or t
  misc_feature (361)..(362): n is a, c, g, or t
  misc_feature (364)..(365): n is a, c, g, or t
  misc_feature (367)..(368): n is a, c, g, or t
  misc_feature (371)..(371): n is a, c, g, or t
  misc_feature (374)..(376): n is a, c, g, or t
  misc_feature (379)..(379): n is a, c, g, or t
  misc_feature (381)..(381): n is a, c, g, or t
  misc_feature (606)..(609): n is a, c, g, or t
  misc_feature (678)..(678): n is a, c, g, or t
  misc_feature (681)..(681): n is a, c, g, or t
  misc_feature (683)..(683): n is a, c, g, or t
  misc_feature (687)..(687): n is a, c, g, or t
atcattctctgaagagcatattttattaatcttcaagttcctcagcatattaataataaaaaccttgatatatattatcaacaagtctgactgttatgcccaaagaaaatccagattattttaagtgagtttgttctttttcatctgattcatcatccataacctgttctacgccttctactccggaatataaaactgcagcatgttctgaattccattggaggtatgatgccaccacagccaggcatcccacagcaacaaggaatgagacccccaatgccacctcatggtcagtatggtggtcatcatcaaggcatgccaggataccttcctggtgctatgcccccgtatgggcangganngnnannggngcnnnctnancagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacattattttacatgggnnnnttatttggaataataaagcaggaacttttcctgaagttgcaatttaaaaaaaaaaaaaaaaaaaaaaanaananaaanaaaaaaaaaaaggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagataacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349169 - DNA, 1566 bp, Homo sapiens
ttcagcaatctggaataaatacaaagcattgtaaatttaatttttggtgaggaggtagaagacatctaacaagttaaatatgcagtcttatttccactgctgtgttgtgggtgtgactttaacctagcatcttttgatatttttatgggttatcttgaattttgtggaatgtttatcacattaactttgtattaatttcatttaaagtttggtcctttatttaatgttgatgccttgttttaagttaaactgttgtagatatagttaatttaaggttttgaagtttcgttgatgaagtattgtattttacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgca

SEQ ID NO: 349170 - DNA, 1022 bp, Homo sapiens
  misc_feature (772)..(772): n is a, c, g, or t
  misc_feature (789)..(789): n is a, c, g, or t
  misc_feature (802)..(802): n is a, c, g, or t
  misc_feature (812)..(812): n is a, c, g, or t
  misc_feature (836)..(836): n is a, c, g, or t
  misc_feature (839)..(840): n is a, c, g, or t
  misc_feature (848)..(848): n is a, c, g, or t
agtgcttgacgggaggcggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggattgcatcatcagagaaaatacacccagtcattttgcggtgaaaacataatgatgcnatggtggatgatgcacntggacaggatacnactctatgcnggatgcacaggtatgcccactgtncanntctggatnctccatggtcaggcaagtgtcagcgccggatttatgacaccttgcaaaagagactgcccaactcagataagctttccggggatggactggcacatagttcaataaggtcgtttcaagtccccaaactgcggcgacgtgatacttgcgcaaaccacgtcgttgcaaaaaggaata

SEQ ID NO: 349171 - DNA, 547 bp, Homo sapiens
cggtagaacacagttatgggtcgcaagaagaagaagcagctgaagccgtggtgctggtatcctttgtcggtttgaagtcgaggtcgcgttggggtgccggttgttggggcctgggactaggaggcctggatttggcttacggcgtggagcgtttgtatttaggcgtctgcgtgggtggcctggtggctgggattggacttgggaaggcttctaggaaaatggggttccgaggtcgacaggcttttgcagttgtgggtcgtgtgactctgtgactcaggaggatcttgttcggtgcgaattttggactccgggaggcggcctggacccctccgccagggacagtgtcccctagggactattcagccaccttccgttgttttggtgacgattcaacaagggacttttcttcgagtgcgataggcttattactttcatggagggttggggacagcttcacagtctgtcacccactttttctgtttttatttactttatgtgtgttttgtgtttattttttcgaattggcggtttagtaaagaaccaagtt

SEQ ID NO: 349172 - DNA, 569 bp, Homo sapiens
cggcaggatggagggaccaggaatgtgggcgtcggggcaccagtggcaccacaggagaggagccactgacatcctgggcaccgcctgcccccaggtgaacacacccgcagccgaggtgctctacacagtcatccaggactgggcccaattggatgcggggagcatggtgctggacgtgtgctgtggcaccggcaccattggcctggccctggcccgggtgagccctcctgccctgctgagggcaccctctccccaccccaagacccccattgaccccagctcaaagtcaccacagctgactccatcatgccccaggcccagctcctctttgctgcccacagggccccatgtactcccctccctgggtggggcgacaccacgctttcctgtttcagaaggtaaagagggtcattggggtcgagctatgcccagaggctgtggaggacgcccgggtgaacgcccaggacaatggtgagtggcaaggccgtgggtgggggtggggagggcacataaccccagggacagcatatcagagctttgaacagggtgtgaaaggaactcttccggga

SEQ ID NO: 349173 - DNA, 3643 bp, Homo sapiens
gccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtgaggacctgtgacggggctcccgggaagtcctatgcggtgtgggagcagagggtggtgatcctgccccgggaattctggagtgcctgccatttcagccagatgaaggaaggtgtggccagaggagagagcagggggactgcttgcccagttgtgggcacttgggccagctcgtgattcccacaggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattcaaaaaaaaaaaagaaaaaacaaaaaaaaaaagaagaaagaagacacacaagaaaaaacaaacacgacaagaaggagtacccaaagaaaagaagcaaaaaaaaaagaagcgggcggcgggcgcacctttatgattttcacttctttacgatgcgtcagtgcctataacttatctatcatccatactacagcgtcctgcttgtttttttcatcactacgtatcgcttcgatcctttttatgcagcttgtgtattgtcttatttatgctataattccttgctgcgcagcgatgttagatttacaaatattctcgtgtgtccgggtcgcagacaatacccccgacgtcctgcgccggttccagcctacaatcatcgcacaaacaaggacagcactcaccgccatgggggcacatgacatcacccaccgcatcagcccccagcagcacatcccgccctataccacacatccctcgtaaccccatgtcccaggcgcatcacacaacatccaacacttcctgatggaaccacatgcccagtgcgaccccaccaccaccgcgttgttagc

SEQ ID NO: 349174 - DNA, 3028 bp, Homo sapiens
gccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaaaaaaaaaaagaaaaaacaaaaaaaaaaagaagaaagaagacacacaagaaaaaacaaacacgacaagaaggagtacccaaagaaaagaagcaaaaaaaaaagaagcgggcggcgggcgcacctttatgattttcacttctttacgatgcgtcagtgcctataacttatctatcatccatactacagcgtcctgcttgtttttttcatcactacgtatcgcttcgatcctttttatgcagcttgtgtattgtcttatttatgctataattccttgctgcgcagcgatgttagatttacaaatattctcgtgtgtccgggtcgcagacaatacccccgacgtcctgcgccggttccagcctacaatcatcgcacaaacaaggacagcactcaccgccatgggggcacatgacatcacccaccgcatcagcccccagcagcacatcccgccctataccacacatccctcgtaaccccatgtcccaggcgcatcacacaacatccaacacttcctgatggaaccacatgcccagtgcgaccccaccaccaccgcgttgttagc

SEQ ID NO: 349175 - DNA, 1502 bp, Homo sapiens
gccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaac

SEQ ID NO: 349176 - DNA, 1786 bp, Homo sapiens
cctgtgggctaccaaggtacaaatttttaatgatgtccatatctgtccacagtctaaaaaggacgcccgagtaaacgctcaggacaattgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattcaaaaaaaaaaaagaaaaaacaaaaaaaaaaagaagaaagaagacacacaagaaaaaacaaacacgacaagaaggagtacccaaagaaaagaagcaaaaaaaaaagaagcgggcggcgggcgcacctttatgattttcacttctttacgatgcgtcagtgcctataacttatctatcatccatactacagcgtcctgcttgtttttttcatcactacgtatcgcttcgatcctttttatgcagcttgtgtattgtcttatttatgctataattccttgctgcgcagcgatgttagatttacaaatattctcgtgtgtccgggtcgcagacaatacccccgacgtcctgcgccggttccagcctacaatcatcgcacaaacaaggacagcactcaccgccatgggggcacatgacatcacccaccgcatcagcccccagcagcacatcccgccctataccacacatccctcgtaaccccatgtcccaggcgcatcacacaacatccaacacttcctgatggaaccacatgcccagtgcgaccccaccaccaccgcgttgttagc

SEQ ID NO: 349177 - DNA, 768 bp, Homo sapiens
cgacaggtagagcaagtgagcaagctctttggctaggggttccccagggctggccctgctgggagggcatgtggccctctgacaggccacggtgccatctcttcagagttgagtaatgtggagttccactgcgggagggccgaggacctggtgcccaccctggtgagcagactggcctcccagcacctcgtggccatcctggacccaccccgtgctggcttgcgtgagtggcttttgcttaaggaggtggcacgggaacgaggacacatggggtggctcaccatgttatgcactctctggctgtggggacccagctggtgtttgcctcctcagattccaaggtgatcctggccatccggagagctaagaacctcaggcggctgctgtacgtctcatgcaacccccgggcagccatgggcaactttgtggagtgagtgtctgcaggggcctgggtgggggctaggcctgctaccaagcccccagctcccacaggagcccctgattagcctatcggctgaccttagcgccccccttttccccccacagcctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttccc

SEQ ID NO: 349178 - DNA, 2466 bp, Homo sapiens
gccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaac

SEQ ID NO: 349179 - DNA, 2342 bp, Homo sapiens
gccaggatcatagagacgctcggcctccgccgcacgcgctggcggactaagagtggctggcgaagcgagcggccggcgcgggcccctggcgggcgggcggtacagccccaagcctgagacccggacctgagcatcgcaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaac

SEQ ID NO: 349180 - DNA, 3457 bp, Homo sapiens
gccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattcaaaaaaaaaaaagaaaaaacaaaaaaaaaaagaagaaagaagacacacaagaaaaaacaaacacgacaagaaggagtacccaaagaaaagaagcaaaaaaaaaagaagcgggcggcgggcgcacctttatgattttcacttctttacgatgcgtcagtgcctataacttatctatcatccatactacagcgtcctgcttgtttttttcatcactacgtatcgcttcgatcctttttatgcagcttgtgtattgtcttatttatgctataattccttgctgcgcagcgatgttagatttacaaatattctcgtgtgtccgggtcgcagacaatacccccgacgtcctgcgccggttccagcctacaatcatcgcacaaacaaggacagcactcaccgccatgggggcacatgacatcacccaccgcatcagcccccagcagcacatcccgccctataccacacatccctcgtaaccccatgtcccaggcgcatcacacaacatccaacacttcctgatggaaccacatgcccagtgcgaccccaccaccaccgcgttgttagc

SEQ ID NO: 349181 - DNA, 2684 bp, Homo sapiens
ggcacgaggctggaacacccacgctgacttcgccgacgagtgccccaagccagagctgctggccatccgcttcctgacccaggcacggtcgctacctgcgttgggcttcagctccatcatcggcgtgatgtagtggttggcacagatcttcagggtcttgtccctccgcatgaggaggcggatggcccctttctccttgtgcttcaggagcttgacgtcaccagtgcctcgctccttccattctgggagatcgttctcagaggcactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgagcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaacaaagggtgtttctgtgatgagagccaggggtctgaacacagggcctgggtgccagggaaagggccaaactaggcctaggcagctctgcaagcctctctgcatggctgggggagtcagggcagagcttactttaaaaaagaatgttcgatttgatacttaaacttgaggagaggcagagagaggtctgggaactgcaccagctgggggcatggggtggagaacactgggcagagttggcccctctgtggccagcctggccctcagcccagcagagagggcatcaaccaaggaaggggccatgctggggtgctgctcagctgttacaaaggcagggtccagcctgcagggaggccccaggaggggatctggccagtcaagggtccacagggtgccagcctctcaccctcagaataaagacatcagccattcaaaaaaaaaaaagaaaaaacaaaaaaaaaaagaagaaagaagacacacaagaaaaaacaaacacgacaagaaggagtacccaaagaaaagaagcaaaaaaaaaagaagcgggcggcgggcgcacctttatgattttcacttctttacgatgcgtcagtgcctataacttatctatcatccatactacagcgtcctgcttgtttttttcatcactacgtatcgcttcgatcctttttatgcagcttgtgtattgtcttatttatgctataattccttgctgcgcagcgatgttagatttacaaatattctcgtgtgtccgggtcgcagacaatacccccgacgtcctgcgccggttccagcctacaatcatcgcacaaacaaggacagcactcaccgccatgggggcacatgacatcacccaccgcatcagcccccagcagcacatcccgccctataccacacatccctcgtaaccccatgtcccaggcgcatcacacaacatccaacacttcctgatggaaccacatgcccagtgcgaccccaccaccaccgcgttgttagc

SEQ ID NO: 349182 - DNA, 956 bp, Homo sapiens
  misc_feature (931)..(931): n is a, c, g, or t
gccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggacgacaagatgtgtgctgcttgagtgtgcctggtgggcttaccaatgtggccggggcctcagccctgggctctacagccttaaccatccagtgggaattgaactttttggtttacctctgagatctttaaaccttgtgaggctttgcacggaaaacctggttgcctccgcgcaaccggtccccatgggcgttttccaatggcagaccgttcctgggctgcctttacccatttggggtggcccactggcctattttggcggttccgtagcgaatgtgcgcccgcctaaaccaatagtagagcgccgaaaagaagcgtccgttttagtggtcgcaaaaagacaccgacctcgtcagttgacaatggcgcagtttatatggttggacaccgagtttttcccgtcgacaattgaccagctttggcccaggcaaagaatggggggaaccacaaatggggcccccttggcgcgccaggttntttttgccacttgggttgcccccta

SEQ ID NO: 349183 - DNA, 564 bp, Homo sapiens
ctcattttaacagcatccatttgtagagcatcactaggaattagattctgtactagacagagcctgatgcatatatgtatacatgtatatatgaatgtatataaatatatatgtgtgtgtatatatatacacacatatacaaatatactgtatgttatgtgatgcccacaaaaactctatgaagtagacactatgagccccattttgtagaggaaattccagtttagactgactacaaactttcccaagatcacagtgattgattggcagagccaggatcccactccaaagcctgtacttttctccttgttctctgctgtccctgtactaggtggattcatcaccattcattgctctaattggactttgttttctttacagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaa

SEQ ID NO: 349184 - DNA, 838 bp, Homo sapiens
  misc_feature (761)..(761): n is a, c, g, or t
  misc_feature (768)..(768): n is a, c, g, or t
  misc_feature (805)..(805): n is a, c, g, or t
  misc_feature (826)..(826): n is a, c, g, or t
  misc_feature (833)..(833): n is a, c, g, or t
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctcccctgcggtttctgaagttcncaaccantggagaaccaaggggccaattctggcaaaaacggacngggccggcctgccctttggcngttttcnccggg

SEQ ID NO: 349185 - DNA, 1219 bp, Homo sapiens
acagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagacagacagacacagacagacagacagacagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349186 - DNA, 670 bp, Homo sapiens
cacgagggaaactcctcggacaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaataccttataccacataacttaactatatcgacccttacgactttattacatcagaccagtatccctacaaaattacttcattatatcatcttgtatacacttattcagcaattttactcctactcacactttcaccataacttatatctcttgcaaccaaccattaccaccatctttacctttattactttacccaatgtactgcatcctagcaattcttctctcatttatctcccatgaccctcattctcactcagtgtaccctctcatccttcctccttcactgaatctcagccaatctaccactcacgtctccctttactctttccatttcacttacttcctacgctctacttcctctccatgttactctccccctctctcctctctcctctttccacctctatcctttccctccg

SEQ ID NO: 349187 - DNA, 514 bp, Homo sapiens
gctttttgtaaacagtttattttgtcttccagccataagacctctgagctgttcctcccagctacgagctgccccaggtacagtaatttgtaaaataaatatttctgatttaaatgttagattccagattctatagtttgtgaactctgaataaaaaccaaaactaatttgctaattctcccctttttatgagcacatgaacatctctgttgccttcaaattaaaaaattataggtccaatcaataatgatactacattatttaggattaggcttgaggatgttaatgggaggctgttttctgggatttgaacctgctggagtcatggaggttccataaacctcgttggtcagtttatttatcctcttgctgtccgtcctggaggtgaatggcatacaaatgctcttgagacctgctatggaaccaaaagttaactttaaatttgcaatttgtgaaatgcttctctattgatgaatatcttcttctcccatgtgcaagagggcccattcctgaa

SEQ ID NO: 349188 - DNA, 2037 bp, Homo sapiens
  misc_feature (1124)..(1126): n is a, c, g, or t
  misc_feature (1129)..(1129): n is a, c, g, or t
  misc_feature (1132)..(1132): n is a, c, g, or t
  misc_feature (1153)..(1153): n is a, c, g, or t
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgaggatnnntgntgngtctcggatccaagatcactnttactgggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349189 - DNA, 2724 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccagggtgaaatgaaatgcttcatgacacttattagggagttctgaattgctcctaaaactcaaaaacatcccgagtgatttttccataagtatgttggttctgtttccaaagtattcagcctttattcttaaatatggatgcaaattttgatttatgttgtaacaataggttaacattttttaatgtttctataagagtgtccttttaagatctgagcactaatctcagcactttgggaggctgaggcaggaggatcgcttgaggccaggagttcaagaccagcctggtcaacagcgtgagacttcatctctaattaaaaaaaaaaaaaagaaaaacagagtctccttttagatcttgctgatatattttagttcttacatacatgcctgtttttaaaattcctgaatcgtctgacttctgtatagaatagccaactgtgaatgaatgtcttaagaaaatagggtgtcctatttttagtaaagcatttagatgatttcccaattgtcttttaagactttagtttaaaatttgataatatgataattataaaacactttccttctagtgaataggtaaggtttatatttcatttgtttttgtaatttttaaagcatatttctgtggagaagatatataaggcttgtggttccatagagttaaaaaaattcatttttttaatagggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349190 - DNA, 1679 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaa

SEQ ID NO: 349191 - DNA, 2043 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaaaaaaaaaaaaaaaaaaaaaaagaagaaaaacacttgtgtggggcgcggcccgcgggcccccagaagaaaagttttctaagaacccatgcgcgttggggcgccgggggccccaagggggtaggggaacagggggacaaaagcgcggtgtgcccaagggagaaacaccgcggggccaacagaacaaagcgaggcggggggttctctccacacatgtataaaaaaaacagccggcggggggaaaacacgcggagcgttgtctggggaaaccaatttcccagaggagggactctagagaaggcacaacagcggggtctcttacaccgggagggagggtcccagaggaagctcgcgaaataaaaatagg

SEQ ID NO: 349192 - DNA, 1678 bp, Homo sapiens
  misc_feature (1124)..(1126): n is a, c, g, or t
  misc_feature (1129)..(1129): n is a, c, g, or t
  misc_feature (1132)..(1132): n is a, c, g, or t
  misc_feature (1153)..(1153): n is a, c, g, or t
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgaggatnnntgntgngtctcggatccaagatcactnttactgggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacacagtatcctatctttcgttctgaacattgactcgctcactgtttctataagctctataacagaaaaaaaaaaa

SEQ ID NO: 349193 - DNA, 1979 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctcagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349194 - DNA, 1856 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349195 - DNA, 1675 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349196 - DNA, 2127 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagagagagaatctgaccaacacagttgatcacttgtaggtagatgacactggtttctggttggctcctatatggatggatcattgctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349197 - DNA, 1999 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349198 - DNA, 1982 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccaggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349199 - DNA, 322 bp, Homo sapiens
attattagatgaagaatagttgataagattaagttttaatgttttctagtagccatggatgaggttatcagagttcatagactacaatgtaaactacaaattgttcagctaatccaggatatacttttgttcttctctttttagattccagaatgactactatcttgacttacccctttaaaaatcttcccactgcatcaaaatgggccctcagattttgtaagtttattattatttttttatttttagagattggatttggatttataaacatctcgcacagatactgaatggtattgctttttgtaaacagtttattttg

SEQ ID NO: 349200 - DNA, 2044 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349201 - DNA, 2089 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattggaaaaaaaaaagtacataaaataaataaagtaaaaaaagggaaaaag

SEQ ID NO: 349202 - DNA, 1981 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349203 - DNA, 1999 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataataggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349204 - DNA, 1266 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgcttctccaaaggaggcaatccaaccttggtttttctacccatgtagttttctgcaaaccaatcagaatccatggctttaagtcgacc

SEQ ID NO: 349205 - DNA, 1864 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccagggtgaaatgaaatgcttcatgacacttattagggagttctgaattgctcctaaaactcaaaaacatcccgagtgatttttccataagtatgttggttctgtttccaaagtattcagcctttattcttaaatatggatgcaaattttgatttatgttgtaacaataggttaacattttttaatgtttctataagagtgtccttttaagatctgagcactaatctcagcactttgggaggctgaggcaggaggatcgcttgaggccaggagttcaagaccagcctggtcaacagcgtgagacttcatctctaattaaaaaaaaaaaaaagaaaaacagagtctccttttagatcttgctgatatattttagttcttacatacatgcctgtttttaaaattcctgaatcgtctgacttctgtatagaatagccaactgtgaatgaatgtcttaagaaaatagggtgtcctatttttagtaaagcatttagatgatttcccaattgtcttttaagactttagtttaaaatttgataatatgataattataaaacactttccttctagtgaataggtaaggtttatatttcatttgtttttgtaatttttaaagcatatttctgtggagaagatatataaggcttgtggttccatagagttaaaaaaattcatttttttaatagggaaaagatacagttaccaaagataatggcatccgtccttcctcactggagcagatggccaaactaaaacctgcattcatcaagccctacggcacagtgacagctgcaaattcttctttcttggtaactgtcaatgttatttgtatttagtagtgacttttctatttctgtactctctgtagaaaagcctaatataactttttgtgtgtgttatgaatagagggttaaaaatatagttattcattttaatgtgaaagtggagtcatt

SEQ ID NO: 349206 - DNA, 1989 bp, Homo sapiens
cctttctgggcaggacccgccccttggtcccgcagagccttggtacttggacctgaaccttgctccgagagggagtcctcgcggacgtcagccaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349207 - DNA, 1982 bp, Homo sapiens
agttgagggagcggaaggaaactcctcggacaagattccagaatgactactatcttgacttacccctttaaaaatcttcccactgcatcaaaatgggccctcagattttccataagacctctgagctgttcctcccagctacgagctgccccagctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349208 - DNA, 2271 bp, Homo sapiens
gtctcacatattccctcagccttctcattgtagggacatcacaaagctaagggttttttggtgtagtaatggaccctcaagttaaggatgagaaggtttgtgtgtactacagctggaaaggtgttaggaaccaagcaagcagctctaggggccagctactttgtctcacacaccacatggtatgtccctttcctggtctttctgcttctatcattcttcattctggctggcttatttgctcacttatggtttacaaactctggcttacgaatgacatcagtttaccatcaacctgttcttcctcatggcatctttttagcttcaactaattggcatttctttccatgcttctttgcctagagagagaatctgaccaacacagttgatcacttgtaggtagatgacactggtttctggttggctcctatatggatggatcattgctgtccagaccaaaacgaagaagacgttagccaaacccaatataaggaatgttgtggtggtggatggtgttcgcactccatttttgctgtctggcacttcatataaagacctgatgccacatgatttggctagagcagcgcttacgggtttgttgcatcggaccagtgtccctaaggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349209 - DNA, 1684 bp, Homo sapiens
gacaatagagcatccccgactacatacttccggaagtagttgattatatcatctttggtacagttattcaggaagtgaaaacaagcaatgtggctagagaggctgcccttggagctggcttctctgacaagactcctgctcacactgtcaccatggcttgtatctctgccaaccaagccatgaccacaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggaaaagatacagttaccaaagataatggcatccgtccttcctcactggagcagatggccaaactaaaacctgcattcatcaagccctacggcacagtgacagctgcaaattcttctttcttgactgatggtgcatctgcaatgttaatcatggcggaggaaaaggctctggccatgggttataagccgaaggcatatttgagggattttatgtatgtgtctcaggatccaaaagatcaactattacttggaccaacatatgctactccaaaagttctagaaaaggcaggattgaccatgaatgatattgatgcttttgaatttcatgaagctttctcgggtcagattttggcaaattttaaagccatggattctgattggtttgcagaaaactacatgggtagaaaaaccaaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattgga

SEQ ID NO: 349210 - DNA, 1399 bp, Homo sapiens
gacctggagctgctgcataacaatatctggcatttacacaacgaggcctctgctccggacactgttctgaggcttgacccgtccttaagaacctaggacaaccctgtgcggtgggttttatccttaactccattatacaggccagagaactgagccagggtggagatgttccactgagaagaagccacatggctctccgccggctctcaagccaaaaacagttccgaaaatctgggcggggagcgggccagagagcgctggggctctgcccccagcaccccctccacgcagacgactcggtaactgggttgcaggcccgcggctgcggagtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggttttgggaactcggcaccttcaaaggaggcaagcacagaggcagggcgggcagcgctgctggagcgggcgctgcgggacctggaggtacagaatgccgtgttggtgagcccctcgctgagtggccactatgccctgcccttcctgatgcgaggccaccaccagctacatggatttgtgcccatcgcacccacctccacccagaactacacccaggagcaattctgggctgtgaagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaa

SEQ ID NO: 349211 - DNA, 1163 bp, Homo sapiens
gacctggagctgctgcataacaatatctggcatttacacaacgaggcctctgctccggacactgttctgaggcttgacccgtccttaagaacctaggacaaccctgtgcggtgggttttatccttaactccattatacaggccagagaactgagccagggtggagatgttccactgagaagaagccacatggctctccgccggctctcaagccaaaaacagttccgaaaatctgggcggggagcgggccagagagcgctggggctctgcccccagcaccccctccacgcagacgactcggtaactgggttgcaggcccgcggctgcggagtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaa

SEQ ID NO: 349212 - DNA, 1047 bp, Homo sapiens
gacctggagctgctgcataacaatatctggcatttacacaacgaggcctctgctccggacactgttctgaggcttgacccgtccttaagaacctaggacaaccctgtgcggtgggttttatccttaactccattatacaggccagagaactgagccagggtggagatgttccactgagaagaagccacatggctctccgccggctctcaagccaaaaacagttccgaaaatctgggcggggagcgggccagagagcgctggggctctgcccccagcaccccctccacgcagacgactcggtaactgggttgcaggcccgcggctgcggagtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaa

SEQ ID NO: 349213 - DNA, 1152 bp, Homo sapiens
gacctggagctgctgcataacaatatctggcatttacacaacgaggcctctgctccggacactgttctgaggcttgacccgtccttaagaacctaggacaaccctgtgcggtgggttttatccttaactccattatacaggccagagaactgagccagggtggagatgttccactgagaagaagccacatggctctccgccggctctcaagccaaaaacagttccgaaaatctgggcggggagcgggccagagagcgctggggctctgcccccagcaccccctccacgcagacgactcggtaactgggttgcaggcccgcggctgcggagtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggttttgggaactcggcaccttcaaaggaggcaagcacagaggcagggcgggcagcgctgctggagcgggcgctgcgggacctggaggtacagaatgccgtgttggtgagcccctcgctgagtggccactatgccctgcccttcctgatgcgaggccaccaccagctacatggatttgtgcccatcgcacccacctccacccagaactacacccaggagcaattctgggctgtgaaggtactgggagaaggatctcaaaggtcctggcaccctgtctgtggcttgggggggttcaggactcaagtcttacttggagggacatggccttatccctgaccttggatggaagag

SEQ ID NO: 349214 - DNA, 1115 bp, Homo sapiens
aagagaagatgtctcgctctgtcgtccaggctggagtgcagtggcgcaatcatggatcactgcagccttgaccttcctgggctcaagtgatcctcccggctcacccccagtagctggaaccacaggcgcgcttccacaccggaaagcccattttctagaggcggaaaccgaagcgcccagtgggaaaggcgacccgccggggatgcggggtgctcaacgcgctgccacctggggcccaacgcgttgacctcgcggtcaggttgcttccgcggactacggttctggctcgctagctctggaagggagcaccgggagggaatggtggcaactcccaaggaggggacccagggatccgagaaaggaagacttggggtaggtggggttggattttgactggagagaagaaagggtcaggagtgcagggcgggtacctggggagctgcgtggactcgcgcagacgggaagcaggcgcgtgctggcggtgacctggggccggaggaggaacgctgggaagaggccgggccccatccagcgggggcggggactgggccgtgctccggggcgccctcttgtggccacaagctcgcagcgtccatagactccgctaaactcgttctcacagcggcgtcagtttcccaaagcctctcggtctcacatgccccaaacgcggtgctgagcacggtttcgaactcttcagcgacctgccccacatggacatggagcagtctgaggaggaaagttccttcgggatcgcatccttgctgctgtcttcctgctccccatcccccttatccccagcttgaactgcccagggcaacttgttggcctggcacggagttgaggcccgacaggtttgagtgcgaggctccgccagtgtccagccaagtggccttgatcgttttcccaatgcccccgagcctgtttcctgccagtagagcgggtcagatgttgccaacctctgcagagtagcaataagcagtaaacgccacgctctgcacagcctcccagtgctgggcctggtcgccacgcggagccttgggctgggacaggccagacgttggtaacacatcgccaaccagggcaggcgccatgagtagacgtgaacgagcccaggg

SEQ ID NO: 349215 - DNA, 1318 bp, Homo sapiens
cccaaaccctgcccagaagcctgccccttaagtacctggcaggtcaatggccacagcccggtagccagcctgggccagcctgtgcagtgtacccaggttctgccaggtctcggaggagaagcgaataccatgcagcagcagtacagagaagcgagcctgcccactgccgggcagggcctctcggaagaagagggcctggccctgcacctggatggtgccctcgcgctgctccacgcttgctgccatgcctgctgctgctgtgctggtgaagggcctgtggttcaaaaccacgatgatgaggggccacagaacaccctgcccagggtggcagtcccagaggagcagcaaggaagcctccaggaggtttccagaactttaagaacatgccttgggactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggttttgggaactcggcaccttcaaaggaggcaagcacagaggcagggcgggcagcgctgctggagcgggcgctgcgggacctggaggtacagaatgccgtgttggtgagcccctcgctgagtggccactatgccctgcccttcctgatgcgaggccaccaccagctacatggatttgtgcccatcgcacccacctccacccagaactacacccaggagcaattctgggctgtgaagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaa

SEQ ID NO: 349216 - DNA, 1288 bp, Homo sapiens
gacctggagctgctgcataacaatatctggcatttacacaacgaggcctctgctccggacactgttctgaggcttgacccgtccttaagaacctaggacaaccctgtgcggtgggttttatccttaactccattatacaggccagagaactgagccagggtggagatgttccactgagaagaagccacatggctctccgccggctctcaagccaaaaacagttccgaaaatctgggcggggagcgggccagagagcgctggggctctgcccccagcaccccctccacgcagacgactcggtaactgggttgcaggcccgcggctgcggagtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggttttgggaactcggcaccttcaaaggaggcaagcacagaggcagggcgggcagcgctgctggagcgggcgctgcgggacctggaggtacagaactacacccaggagcaattctgggctgtgaagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaa

SEQ ID NO: 349217 - DNA, 507 bp, Homo sapiens
cccaaaccctgcccagaagcctgccccttaagtacctggcaggtcaatggccacagcccggtagccagcctgggccagcctgtgcagtgtacccaggttctgccaggtctcggaggagaagcgaataccatgcagcagcagtacagagaagcgagcctgcccactgccgggcagggcctctcggaagaagagggcctggccctgcacctggatggtgccctcgcgctgctccacgcttgctgccatgcctgctgctgctgtgctggtgaagggcctgtggttcaaaaccacgatgatgaggggccacagaacaccctgcccagggtggcagtcccagaggagcagcaaggaagcctccaggaggtttccagaactttaagaacatgccttggggtcaggaggacataggtgttatttctgcctctgccatttactttagtgtgtaacctggggcctcagcttcttgatctgaaatatgggaacaataaagccaacttcaagaattag

SEQ ID NO: 349218 - DNA, 1297 bp, Homo sapiens
aagagaagatgtctcgctctgtcgtccaggctggagtgcagtggcgcaatcatggatcactgcagccttgaccttcctgggctcaagtgatcctcccggctcacccccagtagctggaaccacaggcgcgcttccacaccggaaagcccattttctagaggcggaaaccgaagcgcccagtgggaaaggcgacccgccggggatgcggggtgctcaacgcgctgccacctggggcccaacgcgttgacctcgcggtcaggttgcttccgcggactacggttctggctcgctagctctggaagggagcaccgggagggaatggtggcaactcccaaggaggggacccagggatccgagaaaggaagacttgggactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccaggttttgggaactcggcaccttcaaaggaggcaagcacagaggcagggcgggcagcgctgctggagcgggcgctgcgggacctggaggtacagaatgccgtgttggtgagcccctcgctgagtggccactatgccctgcccttcctgatgcgaggccaccaccagctacatggatttgtgcccatcgcacccacctccacccagaactacacccaggagcaattctgggctgtgaagactccaacccttatcctgtatggagagctggaccacatcctggctcgagagtcactgcggcagctccgccacctgcccaaccactctgtggtgaagctacgcaatgcaggccatgcctgttacctccacaagccgcaagacttccaccttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaa

SEQ ID NO: 349219 - DNA, 1016 bp, Homo sapiens
gacctggagctgctgcataacaatatctggcatttacacaacgaggcctctgctccggacactgttctgaggcttgacccgtccttaagaacctaggacaaccctgtgcggtgggttttatccttaactccattatacaggccagagaactgagccagggtggagatgttccactgagaagaagccacatggctctccgccggctctcaagccaaaaacagttccgaaaatctgggcggggagcgggccagagagcgctggggctctgcccccagcaccccctccacgcagacgactcggtaactgggttgcaggcccgcggctgcggagtgcgcaggcgcgccgagatggccgcgctcctggccgcctagagccggagcggcccgcggagctgcggaggcagccatggtcggggcgctgtgcggctgctggttccgcctgggcggggcccgcccgctcatcccgttgggcccgactgtggtacagacctccatgagccggtcccaggtagccctgctgggcctgagtctgctgctcatgctcctactgtatgtggggctgccaggcccccctgagcagacttcctgcctctggggagaccccaatgtcacagtcctggctggtctcacccctggcaactcgcccatcttttaccgcgaggtgctcccactcaaccaggcacacagggtggaggtggtgctgcttcatggaaaggcctttaactctcacacgtgggagcagctgggcacactgcagctactgtcacagaggggctaccgggccgtggcccttgaccttccagcttgtcctgcttgccttccttgaccatctaccttgaactaacccactcccagctcccagcctggcatgagcttggacagtctggaccgccaccctccctgaaccagggagacagcctctgggattggaggccagaggccagggtcagacccagccaggactcctcatttcatctcacagacacaataaaaaagcatatttgtcctgcctgggaa

SEQ ID NO: 349220 - DNA, 3215 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggacttttatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349221 - DNA, 581 bp, Homo sapiens
gcatagggggcacagccaccaccacaagaggcttctggggagatcagggtaaggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcatta

SEQ ID NO: 349222 - DNA, 780 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctgtgagtgagattcaggggaggggaagggaggactggaacgtgaaccgtggacctgtactccagagcacaggctaccccccacagctgtacaggacagataatttaggaagttaatttgcatagtctctgtgctgttccactctagggcttctcaactgcctgggccctcagccctttgccttctcacctgcagcctgggcagccccaacaactccccctcccccagga

SEQ ID NO: 349223 - DNA, 591 bp, Homo sapiens
tgcatgatgagtcccaaggagaggaaagcagaaagtgacctcaaaccacagcctctccccactcctaggtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctgtgagtgagattcaggggaggggaagggaggactggaacgtgaaccgtggacctgtactccagagcacaggctaccccccacagctgtacaggacagataatttaggaagttaatttgcatagtctctgtgctgttccactctagggcttctcaactgcctgggccctcagccctttgccttctcacctgcagcctgggcagccccaacaactccccctcccccagga

SEQ ID NO: 349224 - DNA, 3346 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349225 - DNA, 3289 bp, Homo sapiens
  misc_feature (30)..(30): n is a, c, g, or t
agtccaaggctgtacggtcctgagatttangatcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349226 - DNA, 3540 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggtgagaggggcctgggcctctcctgatctggaccagcatcctccactctgcctcctggccctgtgacctgctgctttctgcatcccctcccctcaggcttcatcaaggttctgctgtacatggccttcatgaccatcatgatcaaggtgcacaccttcccactctttgccatccggcccatgtacctggccatgaggtgagcccggccctgtcccccgatcctcctgacctgatcccgtcccttctcctgctttcactgactgtcctttcagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349227 - DNA, 3157 bp, Homo sapiens
tgcatgatgagtcccaaggagaggaaagcagaaagtgacctcaaaccacagcctctccccactcctaggtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349228 - DNA, 3301 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349229 - DNA, 3242 bp, Homo sapiens
tgcatgatgagtcccaaggagaggaaagcagaaagtgacctcaaaccacagcctctccccactcctaggtcctgtacatccaggcctttgtccttgtcttccttctgggcaaggtgatgggcaaggtgttctttgggcaactgagggcagcagagatggaggtaagatgtcggctgccccaaaggtgagggcagggtgctgggaaagaatgtttggtatccacattattccctgcctggcccccagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349230 - DNA, 2668 bp, Homo sapiens
tggttcttggcctttgacacctgccaattcaggctgcctatctacaggcccaccaagggtctccaggagttcttggtaactcctggtgcctttatttcccactccagaaagcatgtctggatctaagtaggagtgatgtttattcgagagctgactttagatcttattcctttatatttttctaaagtcaaattattcagaatttgcagtgctttagttcatcacatgatattcttctgagatgtggtgacacttagattggcaattgctgcccccaaactgagggagcgaataataggaagtcacttggagccatcctggctcaagttcaagcgctggtcccatcactcatttttgacctctcattatttgaataaaggggtcttaattcatattcataagtgatgtgtactgccagatacacacctataatcagcactttggaaggctgaggcaggaggattgtttgagcctaggaatttgagggtgcagtgagctatgattgtgccactaaattccagctttggtgacagagccgagacgctgtcttttaaaaaagtgacatgtacataatgcctggcatctagcagtgacagcacaggcttggagaggaacttgagtccaaggctcgagcactgtggcttattgagtgagtcccctataaggtgcctgactccccagggtggagactgcagggtaagagtgaacaggtcaacagtccctgcccgcaagcaccttacagctaagggatagaatcatttggcccttgagtccagtcaccctgtctgagttcattcagcatgttcacttgtgtttgccaggcactggggccacaagggcacatcattctatactctgttctgcaaggctcaccaagggcaggagaatctgcccaaccttggatgccaaggccaggcccgcctctcgtcccttctcttcccaggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccaggtaggtgtgattggcctccagccgggggagcagggaacttctctaggttccacttccagtctctctgtccccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349231 - DNA, 3060 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctggccggggggacacggtactggacctctgcccggttttccccggattggttaccaatgttgacacgttgatatttctatggtatttcacattacgccagtgataggccaatcgcctccacatacacactggggcggccaagcataggttccgggcgcacacgcggcgcgcacgacct

SEQ ID NO: 349232 - DNA, 1168 bp, Homo sapiens
  misc_feature (1154)..(1154): n is a, c, g, or t
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccgagtccagaattgccccgagtccagaatgccccgagtccagaatgccnagatcctctagagt

SEQ ID NO: 349233 - DNA, 1076 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgaggtgagcccggccctgtcccccgatcctcctgacctgatcccgtcccttctcctgctttcactgactgtcctttcagacagttcaagaaagctgtgacagatgccatcatgtctcgccgagccatccgcaacatgaacaccctgtataacaggaacccacatgatgggggatcctgtagatcgacaacaagcat

SEQ ID NO: 349234 - DNA, 1091 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccaggtgggaggggccctggggagcctgc

SEQ ID NO: 349235 - DNA, 676 bp, Homo sapiens
tgcatgatgagtcccaaggagaggaaagcagaaagtgacctcaaaccacagcctctccccactcctaggtcctgtacatccaggcctttgtccttgtcttccttctgggcaaggtgatgggcaaggtgttctttgggcaactgagggcagcagagatggaggtaagatgtcggctgccccaaaggtgagggcagggtgctgggaaagaatgtttggtatccacattattccctgcctggcccccagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctgtgagtgagattcaggggaggggaagggaggactggaacgtgaaccgtggacctgtactccagagcacaggctaccccccacagctgtacaggacagataatttaggaagttaatttgcatagtctctgtgctgttccactctagggcttctcaactgcctgggccctcagccctttgccttctcacctgcagcctgggcagccccaacaactccccctcccccagga

SEQ ID NO: 349236 - DNA, 3420 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccaggtaggtgtgattggcctccagccgggggagcagggaacttctctaggttccacttccagtctctctgtccccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349237 - DNA, 3243 bp, Homo sapiens
gcgttacagagcaccaggtctttgtctcattcttctgtgttccctgttttaaatttttttcccgaacggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349238 - DNA, 3242 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtcttatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349239 - DNA, 3303 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349240 - DNA, 2404 bp, Homo sapiens
gtctggccacccggcataccactggatacttgccctgggctggatgtggaagatgctgggaaattggagagtccctgccctccagaatctcagtctgggccagggagggattaaaagatgagaaatagatgcttgcagtcagtgtgaccagtgctgggctgagggcctgtgggaataggacagagctctcaatagccaggccccctgcctgggagttgggtctgtgtccatttggccctttccttacctccgtcttctctctgcagtcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349241 - DNA, 2648 bp, Homo sapiens
catggccttcatgaagcctgtaaacaggctctgtgtagagcatgtacacagccttgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagctgcctgcgctcctggttccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcattaacaattggtggggtttgtgtcacagaatcgatcaaatcagtgtcgggctccttgctgtggctgtacacttgaaaatggaatggaatctccaggagtgagggtttccatggaagccagcactatccttggggacaccactgaccattaacagattaggaagatgtgcccattttacacacagagaagcagcccagagttcagtgccctgcttcagggcagagaccaagttggggagtcaggaactgaaagctgtcttagccagtttgggggcagggtggggtctcaggcctttg

SEQ ID NO: 349242 - DNA, 3053 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgacactgccccagcccagccccagcctctgctcttttgagcagccctcgctggaacatgtcctgccaccaagtgccagctccctctctgtctgcaccagggagtagtacccccagctctgagaaagaggcggcatcccctaggccaagtggaaagaggctggggttcccatttgactccagtcccaggcagccatggggatctcgggtcagttccagccttcctctccaactcttcagccctgtgttctgctggggccatgaaggcagaaggtttagcctctgagaagccctcttcttcccccacccctttccaggagaaggggctgcccctccaagccctacttgtatgtgcggagtcacactgcagtgccgaacagtattagctcccgttcccaagtgtggactccagaggggctggaggcaagctatgaacttgctcgctggcccacccctaagactggtacccatttccttttcttaccctgatctccccagaagcctcttgtggtggtggctgtgccccctatgccctgtggcatttctgcgtcttactggcaaccacacaactcagggaaaggaatgcctgggagtgggggtgcaggcgggcagcactgagggaccctgccccgcccctccccccaggcccctttcccctgcagcttctcaagtgagactgacctgtctcacccagcagccactgcccagccgcactccaggcaagggccagtgcgcctgctcctgaccactgcaatcccagcgcccaaggaaggccacttctcaactggcagaacttctgaagtttagaattggaattacttccttactagtgtcttttggcttaaattttgtcttttgaagttgaatgcttaatcccgggaaagaggaacaggagtgccagactcctggtctttccagtttagaaaaggctctgtgccaaggagggaccacaggagctgggacctgcctgcccctgtcttttccccttggttttgtgttacaagagttgttggagacagtttcagatgattatttaatttgtaaatattgtacaaattttaatagcttaaattgtatatacagccaaataaaaacttgcatta

SEQ ID NO: 349243 - DNA, 2203 bp, Homo sapiens
aggtgtctgacccccgaagttcacggttcgcagggggtgggggagttgttaaccggaggggcagccgcagtcgcgcggattgagcgggctcgcggcgctgggttcctggtctccgggccagggcaatgttccgcacggcagtgatgatggcggccagcctggcgctgaccggggctgtggtggctcacgcctactacctcaaacaccagttctaccccactgtggtgtacctgaccaagtccagccccagcatggcagtcctgtacatccaggcctttgtccttgtcttccttctgggcaaggtgatgggcaaggtgttctttgggcaactgagggcagcagagatggagcaccttctggaacgttcctggtacgccgtcacagagacttgtctggccttcaccgtttttcgggatgacttcagcccccgctttgttgcactcttcactcttcttctcttcctcaaatgtttccactggctggctgaggaccgtgtggactttatggaacgcagccccaacatctcctggctctttcactgccgcattgtctctcttatgttcctcctgggcatcctggacttcctcttcgtcagccacgcctatcacagcatcctgacccgtggggcctctgtgcagctggtgtttggctttgagtatgccatcctgatgacgatggtgctcaccatcttcatcaagtatgtgctgcactccgtggacctccagagtgagaacccctgggacaacaaggctgtgtacatgctctacacagagctgtttacaggcttcatcaaggttctgctgtacatggccttcatgaccatcatgatcaaggtgcacaccttcccactctttgccatccggcccatgtacctggccatgagacagttcaagaaagctgtgacagatgccatcatgtctcgccgagccatccgcaacatgaacaccctgtatccagatgccaccccagaggagctccaggcaatggacaatgtctgcatcatctgccgagaagagatggtgactggtgccaagagactgccctgcaaccacattttccataccagcggcagcagacctgccccacctgccgtatggatgtccttcgtgcatcgctgccagcgcagtcaccaccacccccggagcctgcggatcaggggccaccccctgccccccaccccccaccactcttgcctcagccccccaacttcccccagggcctcctgcctccttttcctccaggcatgttcccactgtggccccccatgggcccctttccacctgtcccgcctccccccagctcaggagaggctgtggctcctccatccaccagtgcagccctttctcggcccagtggagcagctacaaccacagctgctggcaccagtgctactgctgcttctgccacagcatctggcccaggctctggctctgccccagaggctggccctgcccctggtttccccttccctcctccctggatgggtatgcccctgcctccaccctttgccttccccccaatgcctgtgccccctgcgggctttgctgggctgaccccagaggagctacgagctctggagggccatgagcggcagcacctggaggcccggctgcagagcctgcgtaacatccacacactgctggacgccgccatgctgcagatcaaccagtacctcaccgtgctggcctccttggggcccccccggcctgccacttcagtcaactccactgaggagactgccactacagttgttgctgctgcctcctccaccagcatccctagctcagaggccacgaccccaaccccaggagcctccccaccagcccctgaaatggaaaggcctccagctcctgagtcagtgggcacagaggagatgcctgaggatggagagcccgatgcagcagagctccgccggcgccgcctgcagaagctggagtctcctgttgcccactgactattatcattcagaaattccaaacacaagaccacatgaaattctggaaaaaccttcccctccacagccaccacctcctcctcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcaga

SEQ ID NO: 349244 - DNA, 506 bp, Homo sapiens
cttttttggtttctttgactgatttttggatgatatatgttgctttatttctcccattttctttgattactgtggacaaaggaaaacactgaggcaaaagtaggtcgtcaatcacattactttgacccagttgtgcagaacccctttcctacctgcaggtgttaattccaattcaatgcaaatatccttttcaatccggtccattcttggagaagaaacccattgtaagagctgtcttctgtggttgggatattactttgtaaagtattaaagcactaaaccagtttttgcaatatgtagtaaatcttgctttcattttggaaaacttccagtaatgactactgcactttttatagaagaattgtatttaatttctttcttttatgaaagattatttcaagtaaaaatagctctgtaatctgtgtgacatggcttctccattacctgacacagagagaagctttgatgcctactcaataaaattaacatgtttgtaaagtaaaaaa

SEQ ID NO: 349245 - DNA, 377 bp, Homo sapiens
cttttttggtttctttgactgatttttggatgatatatgttgctttatttctcccattttctttgattactgtggacaaaggaaaacactgaggcaaaagtaggtcgtcaatcacattactttgacccagttgtgcagaacccctttcctacctgcaggtgttaattccaattcaatgcaaatatccttttcaatccggtccattcttggagaagaaacccattgtaagagctgtcttctgtggttgggatattactttgtaaagtattaaagcactaaaccagtttttgcaatatgtagtaaatcttgctttcattttggaaaacttccagtaatgactactgcacactgtcgagagggatcctctagacgcccca

SEQ ID NO: 349246 - DNA, 529 bp, Homo sapiens
agggtcttgctgtgttgctcgggctgctcttgaactcctgggctcaaacagtcctcttgcctcagcctcccaacgtgctgggattacgggagcaagccaccccactgtgtgcagcccagaagttgagcctgagaggcactgtgagcagctgttgctatcacacgggcggatcagaacatgaagaatggagctaaatagagctgtctgcatgctgttctgatgggctcaggctcagcctcagagaataggtggattggagcctgtgatgggggctctttcccccaccagagtgggtgaaagcagggaggaacaggcgggaagatactttaggagttgggagggtattaattccacctcttctctccttcctctgtaccccaacattccctgtgagttgtcaagggctggagagataacaaagatctttctttccaccatcaggcagtaaggcaatgcagccctcgctgaattttcagctccactgacattgtgatgcaaatattaaataaagcttattttctgacctgag

SEQ ID NO: 349247 - DNA, 499 bp, Homo sapiens
gagtttctgattcagcaagtctgggttgggacatgagaatttctcacaaattcaccagtgatgctgatgttactggtccaggaactgcactttgagagccactgtaattcaggtattgtaattatgcatggattatgttttctttttcttttcttcttcttcttcttcttttttttttttttttgagacagaatcttgctctgtcacccagggtggagtgcagtggtgtgatctcagctcactgcaatgtccatctcctgggttcaagcaattctcctgccttagtagctggtattacaggcacctgccaccatgcctggctaattttatatttttagtaaagacagggtttcaccaagttgcccaggctggtctcgaactcctgacctcaaatggtccgcccgcctcggtctccccatagtgctgggattacaggcgtgagccactgcacctggcctgttttctctattttcaaaactgtctctatgatcatgtttta

SEQ ID NO: 349248 - DNA, 1520 bp, Homo sapiens
cgccccgggcgcgggcggagggaggaggaggcggcgcgcgcggcgccagcccgcagaagccggtggccgcgcaggaggacggagccctaaccgcaacccgcgccgcgccgcgccgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacata

SEQ ID NO: 349249 - DNA, 530 bp, Homo sapiens
actaaagaagccccttccaggcagagtgcacactttggatctgcttcatggcagaacagagtaatggttaagagctgggttctggagggagcaagatgtgattgtgtgtctgtgtcccagctctgccacctgctagagttgtatcgtgaccttctgaacctcagttgtcttgcctgtaaaatggaaatgaaggggatggttagcactcccactggatcaaataagctgcacctcatacataatgaggaaacagagacccggagagatacagtccttggccagtcagccaagttggagcatagcttggactttgaacccagtctcccagctcccagtctgcctgcagccctgtccctctccacccccaagccctgaccagaattctcttctgtacatccagaagggctttcccattcctcagactctctgaggcaattacagtccctaccactcatgtggcccttaatcatttactgcccttgcaaacagcctgtggtcaaaagcaataaagttcggacttggacagatca

SEQ ID NO: 349250 - DNA, 2016 bp, Homo sapiens
cgccccgggcgcgggcggagggaggaggaggcggcgcgcgcggcgccagcccgcagaagccggtggccgcgcaggaggacggagccctaaccgcaacccgcgccgcgccgcgccgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacataaaaaaaaaaaaaaaaaaaaaaaaaaaataaaaaaaaaaaaaaaaaaaaaaaaaagggggggcccactccaaaaatatatctccccgtgggggcacccacatgattgagcggctatcccgccgtcttttgtgtgtgtcaaaaggggggcccccattatatgtaggggggtcagtatttatgacaggcaggcgcaactaggcagccgcagtcgtttaataaaaagagtctatgctgcgggagaaaacagcgtgtacagcatggtggagagatacttctttgtgagagaagaaaacacatcactatttaagcaggagggagggtagcagccaaaatatttggggcagaacacacccctcatcagcaaagcagatatttaaagaggtcctataagggaggaaaatattatagaaattttacaagagggatagataatagtggtttgtaaacaccaaatgagggtagaattgtgctcagtcgaggggaaaaaaaataatgg

SEQ ID NO: 349251 - DNA, 1447 bp, Homo sapiens
cgccccgggcgcgggcggagggaggaggaggcggcgcgcgcggcgccagcccgcagaagccggtggccgcgcaggaggacggagccctaaccgcaacccgcgccgcgccgcgccgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgc

SEQ ID NO: 349252 - DNA, 1497 bp, Homo sapiens
gaccgcgtttagaggatcagtggcggcggcacccgcggccccgcgcggcgcggacggcgggcagcaccgtgcctgggccccctcctgctccgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacata

SEQ ID NO: 349253 - DNA, 1472 bp, Homo sapiens
cgccccgggcgcgggcggagggaggaggaggcggcgcgcgcggcgccagcccgcagaagccggtggccgcgcaggaggacggagccctaaccgcaacccgcgccgcgccgcgccgatttgatttgtatccactgtcaccagcactgctcacttaggactttctggatccggacccaggcagcgcacactggactcttgaggaagaaggagactctaattttggattccttggtggaggaaaataaaaatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacata

SEQ ID NO: 349254 - DNA, 1500 bp, Homo sapiens
cgccccgggcgcgggcggagggaggaggaggcggcgcgcgcggcgccagcccgcagaagccggtggccgcgcaggaggacggagccctaaccgcaacccgcgccgcgccgcgccgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacata

SEQ ID NO: 349255 - DNA, 840 bp, Homo sapiens
cgccccgggcgcgggcggagggaggaggaggcggcgcgcgcggcgccagcccgcagaagccggtggccgcgcaggaggacggagccctaaccgcaacccgcgccgcgccgcgccgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgaatatactgaatgcaaagtattcgggcaccaggctataagccagcatgggtcaagatctctaaatgcaaat

SEQ ID NO: 349256 - DNA, 1263 bp, Homo sapiens
atatgtcaagaacacctcaacagagctgtaaaaaaaacacgacaggtctgacagttacctgggaaaggtgggggaacaggtggtagaagaacacattttttatgatgttcatggtacttacataacataaatgaataaaatagggccaacatggaaaagaaaacaaaatgaaggaaaatgtcaaattgccatcctgaacaccagcaccgcctgtaattagcgttcctggctgcagccacatctgcggtcctgctcctcatgaagccgtcctccgtgccatgtcccggccatgcctgtccttagcttcctggtgcacactgtcctccaccttgtgttcaggcacagggctgcttggctcacccttgctgcacctggcctgtccgtcctcccaccgcggtgccgcccaggccttcccactgcagggctggctaacggtgcatggaagagactcgagtccgtgttgtgtcctcatagcccaccgaggaggcagcagtgccggacatttcgcggataggttgtggtctctgagtctcctcctctcaagaggatgagatttgtctgtgttattgtcaaaactcttatttgtcacgccgcgggttatgtgtcagtaacaaaaagctgagatttaggccggtgtttcttactggtgcagcctttaaatgcacacctgcgaatgttcagtgcaccttccgcttcctggctctatttcagtcaaacctgaggtcgtagtgaaagtcggtgaggaattctttggaacttcctgattggctgtgtccttgcctccttgtcttcccgcagatttgatttgtatccactgtcaccagcactgctcacttaggactttctggatccggacccaggcagcgcacactggactcttgaggaagaaggagactctaattttggattccttggtggaggaaaataaaaaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacata

SEQ ID NO: 349257 - DNA, 443 bp, Homo sapiens
ggacaatcaccagagagctgaattttacattgatttcacatgtttgtgtcttaggtgacttttcccaactgttaattgatagaaaatgatttgtctgtatccttgaaagattgtactgtattatttaaaaaaaaaccctctaatcttcccatttgacaaatgtgacagaaggctgtgatgaatcagtagcatttaaagtactgacacatacctgtattttgcaggaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcct

SEQ ID NO: 349258 - DNA, 477 bp, Homo sapiens
atagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgctta

SEQ ID NO: 349259 - DNA, 2203 bp, Homo sapiens
atatgtcaagaacacctcaacagagctgtaaaaaaaacacgacaggtctgacagttacctgggaaaggtgggggaacaggtggtagaagaacacattttttatgatgttcatggtacttacataacataaatgaataaaatagggccaacatggaaaagaaaacaaaatgaaggaaaatgtcaaattgccatcctgaacaccagcaccgcctgtaattagcgttcctggctgcagccacatctgcggtcctgctcctcatgaagccgtcctccgtgccatgtcccggccatgcctgtccttagcttcctggtgcacactgtcctccaccttgtgttcaggcacagggctgcttggctcacccttgctgcacctggcctgtccgtcctcccaccgcggtgccgcccaggccttcccactgcagggctggctaacggtgcatggaagagactcgagtccgtgttgtgtcctcatagcccaccgaggaggcagcagtgccggacatttcgcggataggttgtggtctctgagtctcctcctctcaagaggatgagatttgtctgtgttattgtcaaaactcttatttgtcacgccgcgggttatgtgtcagtaacaaaaagctgagatttaggccggtgtttcttactggtgcagcctttaaatgcacacctgcgaatgttcagtgcaccttccgcttcctggctctatttcagtcaaacctgaggtcgtagtgaaagtcggtgaggaattctttggaacttcctgattggctgtgtccttgcctccttgtcttcccgcagatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacata

SEQ ID NO: 349260 - DNA, 484 bp, Homo sapiens
gaccgcgtttagaggatcagtggcggcggcacccgcggccccgcgcggcgcggacggcgggcagcaccgtgcctgggccccctcctgctccgttgtatcgtgaccttctgaacctcagttgtcttgcctgtaaaatggaaatgaaggggatggttagcactcccactggatcaaataagctgcacctcatacataatgaggaaacagagacccggagagatacagtccttggccagtcagccaagttggagcatagcttggactttgaacccagtctcccagctcccagtctgcctgcagccctgtccctctccacccccaagccctgaccagaattctcttctgtacatccagaagggctttcccattcctcagactctctgaggcaattacagtccctaccactcatgtggcccttaatcatttactgcccttgcaaacagcctgtggtcaaaagcaataaagttcggacttggacagatca

SEQ ID NO: 349261 - DNA, 1561 bp, Homo sapiens
ctgacgcttgggggaggagaggtagttgcttggtatttttggctttccaccataaaactggagacagtttccttcattccaagtcgttttaatgtcactgttgaacgtgtgtgtcctgagttctcatctgaaagctttcatatcggttgactgcagatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacata

SEQ ID NO: 349262 - DNA, 1805 bp, Homo sapiens
atttgaactcagtggtttcctgaatctagcaaagtatgctgctttgttttctcttagattaattttgcctaattttaaagctttgattctctttttacgaagacgaaaataaatctctctagtctgggcctttttcgtttcccaggattatgattaaaattatcactaacttttagatagtccagcacgcaccggatgactctgaagccggttgggcagtggagatcgggaagaacatgaaaaagcttcaaagcttttggttgaggacatcgggagatgtaaaccccaaacgcgggttttacttctcccctccacccctccccgcaaacccatgcctactcgttttgactgctcagcaattctgaggccaaccatttgcaacggcgaggagcaggggctgatttgatttgtatccactgtcaccagcactgctcacttaggactttctggatccggacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatcacctgcattgttaatgctaccattgagatccctaatttcaactggccccaatttgagtatgttaaagtgcctctggctgacatgccgcatgcccccattggactgtactttgacaccgtggctgacaagatccacagtgtgagcaggaagcacggggccaccttggtgcactgtgctgcaggggtgagccgctcagccacgctgtgtatcgcgtacctgatgaaattccacaacgtgtgcctgctggaggcgtacaactgggtgaaagcccggcgacctgtcatcaggcccaacgtaggcttctggaggcaactgatagactacgagcgccagctctttgggaagtcgacagttaaaatggtacagacaccttatggcatagttcccgacgtctatgagaaggagtcccgacacctgatgccttactgggggatttagtgccactgaagcctgcgtcagcagcccgagcggggccggcatctgctccccgccgtctgctccctctccactctcttctcaaatggctgacttctggttctccctcaagtgttttttacactgggtgttcaaatttattttaagagatagggagggaggggacataaagggaatgcatacattgctagtcacatttttaaaattaacattttggaatagtgtttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggaccagacagatgcttagggaaggttgataccagcttcagtctctactggattagccctactctttcctttcccctccattatttagtgactctgtaagtaagttaaatacacccttattatttagctgttaagtaactataatgaaatctgctgcaaaatctctcttggaatccatgtgcccaggattatattagcattatttttaataaatctatatgcttaacata

SEQ ID NO: 349263 - DNA, 292 bp, Homo sapiens
ttatccaggaatggattaactgatgaccaggttctgacctcactcactgcccaattgccttctaaaccactgataatggagcttaagctttgaggcaggagatgatggcagttggagaaagaagaaattaagttgctgtatatgtcttgtgggtatctcaaattgcttttaaaagtcaaatataaaaattgtagggctaaatataatttttgtgtaatcaattgtattggtgctctccattctgatatagataatagcagagttaagtgcttgtttatttaaataactttcc

SEQ ID NO: 349264 - DNA, 3586 bp, Homo sapiens
taagagacaacgtctcactgtgttgcccaggctggtgtcaaactcctgggctcaagggatcttcctgccttggcctcccgaagtgctggaattagaggcatgagccactgcacccagccagcaaacattctcttaatcttttaaagtaaccagtaaatctacaaatagtaaagtactattttcatcagggatttttttttttcttattttctagattttacagaaacaatgtgaaattattttggaaagataaggtaggattcttgaataaatctgaagggtctcacaattaagtgagaaacacctttaaaagcatagtaaagctacacctaaataactaaagcctaaatcattgtaatgttttgttggacttactttaacttgacctgttgtagccacaaataacaaatttcttggtaactgatgctattacagtaggtaatcaaaaatgaaaaattctagtcttatatactgcaggtttggggtgattgttaaggcactatcccctctggagaaatgtcatatggcatcagtgtaaacatgcacaagaaagaatttgtaaaaaaaaatgacaggttaatcaatgaaattagttgtatttactgtttggattttatttagtgtttccttgatgtctgtttcctcatctcttatttgttggaagattacttttctacctcttttttttcttttaaaattcctttcttacatttctgttgtttctttttctagtccttctctatctggataataaaatgaatgacaggaaagtcacccacatagaggtttgggatgaaccttttgcagattgctttttgtttcatacaagtataagatcatattttctttttcaacttagtaataggcaggcttcttggaacaataagtagattgatacactcctccccaaatcaaattatattgtatatcttttatattagatgtttgcagaaattctgtggcctttaagatcagttattcagcctttgtaattatgttatctagctatgttgaaaagataagtgcttactatataagcactcttagaaaaataattaactgattactctttcagaaaatagcaggtgtctcaatgctttttttccataattataaagaccattgtcaaaatctttggtttactaaatatttcactgagcatatatagagatacgttgcttgtggcataaaaagtcttgtagataacttactcacatttggcttttttttaattggtgcattttttaatttgcttttttgaaaattatgaagttaaaatttaattctaaggtagtatttttcatgtataaaactaataatgtagttaagcatactgtttgaataaaattataataaatggcacaattccttaaaccctgaaaataccaagttatattggaaaatagtggaaagaaaaaactagtggagaacatcttagaaaattctattgtggaaattacgatgattattttcagtgagaatgaatttatatatacaacaaaaatatacaaaagctaaccttctcatcctaaaaagatttttccctttgcttctgttttatttagccctgccatgcaccacattaattttatgaacataaatgatatttaacttttcttttttttttttttttgagacagagtctcactccgtcaccaggctggagtgcggtggcgcgatctcagctcactgcaacctccatttcccaggttcaagcaattctcctgcctcagcctcccaagtagctgggattacaggcacgcgccaccacgcccacctaatttttgtatttttagtagagacggggtttcaccatgttggtcaggctggcctcgatctcgtgacctcgtgatctgtccgcctcggccttccaaagtgctaggattacaggcgtgagccaccgcacctggccaacttttcatcttaagttgtttaaatttatgcacttttagatatcagaatatatgcttgaacaaaggaaatagtaaattagctatatgtctgctggtttcacttcgatgtggatatggatatgtggataaagacagtaaatgaaattaaaaccctgctgttttaaatatcattaccagatataattgagggaatattatatcaacaaacatattgaaacttggctttatttgtaacgtaaactatatataatccatacgtagccaaattagatttaaaatatacaattaatgaatagtactcaaagtgtttttgttgcactgttactctgaatatggactctctatatctggtatggcgtgactgggcataacttctgtaatgtatttcagttatatgtttttccttttattgccagcttctgataatgaaattttccaaagggatgagatataagaatcatcttttataaaaaccagtggggagtggggtattataatctagttctaaactgtccatttgctttatataaaggctttgatttcaataactgaccatttgatgaatatttaaattacacagaataatgtctacatagaataaacttaagtattcaagagccttaaagtgaaaaaatgaaccttttgactgccttaaaatactacttgctctgtaattcaggcatactagttactttccttggggtctgtttaaataatgccttaatagtgttctaatgtttctgaaatacagaactcaaagggtcttttagagcttttaattttacatagtgaatggaaatttaagtattacattttaaaacctgattgtacattggtaatttaaacatccaataacaggaaaatctagatacagtgatgtgttatacatacatgactgttaacatcagtaatattttatgatagtttaaggttttttattgttttctataacaagttatccaacaggttggactttgtaacatgatatccaaggaccaagttgcatatttaacatcgaatgaaaatgtagttgtacagttccaaaaataattaattttttaagggaatttttcaagacaaaaggcaaatattttgtttcaaacctacaagcaaattcattccaagaagtgaatatagtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaagtttatttcatttccaaggaaaggaccctgaaaggaggggacagggagcttcctaggtctgttgataaactaactgatgctttgtcaagtcttccaagttttcactgtaaataatacaactaacaatgtaattttgctgttttctaatagagaatgaatgaatatattaatgtattacatttgtttcatgataaaacagttttcactgatactgtgaaatcctttctctcctttctagccttgcaaaataccctactaaataaatcattttagacatggagtgcaggtggacactgtgtgaactgtttttggtcagttattgtagaaattgatagatgtaccaaataaactctatgcacattaaa

SEQ ID NO: 349265 - DNA, 3897 bp, Homo sapiens
gggagagcagtagtgagtagtcgctgagtaagagagagtcagcggatcgacgagacgtggagcgaatgagcagatgagaggagtcgcagaggagaacgtgcggagcgcttgatatatagagagcgcgacggagtaggcaagagtgaagagagaggagagttgagagtagcggatatgcgcggcgaggagagatgtgaagacgagagaggtctgaagagacgggtcgagtggttgtccgagtatatagtgagcagcgggttggcacgcggttgtaaacgcgcgagatattgaccgcctagtggcgagtaccaaagggccacgccgagaaaaactgaaagtagagagagtggaaagcgcccaaagtttgtgtagggtggtgtattaagagaccgtcagagtgtttcacagggtgtggcaaatcgtgggacgaaggattctcgcgcgtggccgaccgaagggtggaattagaggccttaacccttgcacagagcgagaacaattctgaatcctttccgaagtttctagattttacagaaacaatgtgaaattattttggaaagataaggtaggattcttgaataaatctgaagggtctcacaattaagtgagaaacacctttaaaagcatagtaaagctacacctaaataactaaagcctaaatcattgtaatgttttgttggacttactttaacttgacctgttgtagccacaaataacaaatttcttggtaactgatgctattacagtaggtaatcaaaaatgaaaaattctagtcttatatactgcaggtttggggtgattgttaaggcactatcccctctggagaaatgtcatatggcatcagtgtaaacatgcacaagaaagaatttgtaaaaaaaaatgacaggttaatcaatgaaattagttgtatttactgtttggattttatttagtgtttccttgatgtctgtttcctcatctcttatttgttggaagattacttttctacctcttttttttcttttaaaattcctttcttacatttctgttgtttctttttctagtccttctctatctggataataaaatgaatgacaggaaagtcacccacatagaggtttgggatgaaccttttgcagattgctttttgtttcatacaagtataagatcatattttctttttcaacttagtaataggcaggcttcttggaacaataagtagattgatacactcctccccaaatcaaattatattgtatatcttttatattagatgtttgcagaaattctgtggcctttaagatcagttattcagcctttgtaattatgttatctagctatgttgaaaagataagtgcttactatataagcactcttagaaaaataattaactgattactctttcagaaaatagcaggtgtctcaatgctttttttccataattataaagaccattgtcaaaatctttggtttactaaatatttcactgagcatatatagagatacgttgcttgtggcataaaaagtcttgtagataacttactcacatttggcttttttttaattggtgcattttttaatttgcttttttgaaaattatgaagttaaaatttaattctaaggtagtatttttcatgtataaaactaataatgtagttaagcatactgtttgaataaaattataataaatggcacaattccttaaaccctgaaaataccaagttatattggaaaatagtggaaagaaaaaactagtggagaacatcttagaaaattctattgtggaaattacgatgattattttcagtgagaatgaatttatatatacaacaaaaatatacaaaagctaaccttctcatcctaaaaagatttttccctttgcttctgttttatttagccctgccatgcaccacattaattttatgaacataaatgatatttaacttttcttttttttttttttttgagacagagtctcactccgtcaccaggctggagtgcggtggcgcgatctcagctcactgcaacctccatttcccaggttcaagcaattctcctgcctcagcctcccaagtagctgggattacaggcacgcgccaccacgcccacctaatttttgtatttttagtagagacggggtttcaccatgttggtcaggctggcctcgatctcgtgacctcgtgatctgtccgcctcggccttccaaagtgctaggattacaggcgtgagccaccgcacctggccaacttttcatcttaagttgtttaaatttatgcacttttagatatcagaatatatgcttgaacaaaggaaatagtaaattagctatatgtctgctggtttcacttcgatgtggatatggatatgtggataaagacagtaaatgaaattaaaaccctgctgttttaaatatcattaccagatataattgagggaatattatatcaacaaacatattgaaacttggctttatttgtaacgtaaactatatataatccatacgtagccaaattagatttaaaatatacaattaatgaatagtactcaaagtgtttttgttgcactgttactctgaatatggactctctatatctggtatggcgtgactgggcataacttctgtaatgtatttcagttatatgtttttccttttattgccagcttctgataatgaaattttccaaagggatgagatataagaatcatcttttataaaaaccagtggggagtggggtattataatctagttctaaactgtccatttgctttatataaaggctttgatttcaataactgaccatttgatgaatatttaaattacacagaataatgtctacatagaataaacttaagtattcaagagccttaaagtgaaaaaatgaaccttttgactgccttaaaatactacttgctctgtaattcaggcatactagttactttccttggggtctgtttaaataatgccttaatagtgttctaatgtttctgaaatacagaactcaaagggtcttttagagcttttaattttacatagtgaatggaaatttaagtattacattttaaaacctgattgtacattggtaatttaaacatccaataacaggaaaatctagatacagtgatgtgttatacatacatgactgttaacatcagtaatattttatgatagtttaaggttttttattgttttctataacaagttatccaacaggttggactttgtaacatgatatccaaggaccaagttgcatatttaacatcgaatgaaaatgtagttgtacagttccaaaaataattaattttttaagggaatttttcaagacaaaaggcaaatattttgtttcaaacctacaagcaaattcattccaagaagtgaatatagtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaagtttatttcatttccaaggaaaggaccctgaaaggaggggacagggagcttcctaggtctgttgataaactaactgatgctttgtcaagtcttccaagttttcactgtaaataatacaactaacaatgtaattttgctgttttctaatagagaatgaatgaatatattaatgtattacatttgtttcatgataaaacagttttcactgatactgtgaaatcctttctctcctttctagccttgcaaaataccctactaaataaatcattttagacatggagtgcaggtggacactgtgtgaactgtttttggtcagttattgtagaaattgatagatgtaccaaataaactctatgcacattaaa

SEQ ID NO: 349266 - DNA, 4895 bp, Homo sapiens
tgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaaccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtgaggacattgcgggaggccggctgggagccttttgtgcggccccagggacgcgcaaattctgaccagtcctccatgtctctcacccgcatcccaggggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaac

SEQ ID NO: 349267 - DNA, 3948 bp, Homo sapiens
tcattttctgcctttcctgatttttcttcaggacatttatattgattttgtactaagggaaaaactatggaacttaaaagatgtttttaaattaaaagagttaataacatttcagtaaacctacattttgttttccttttgtaattttattgtgcccatctagttgtaataacattttgcctttttgttaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaac

SEQ ID NO: 349268 - DNA, 3727 bp, Homo sapiens
aaactgctttaaggaatttttattttcactggaaaaacaaaatagaagatatactcacaggaaacatttactcatttaagatgattttgcaccaaaatctggaagatagcaagagtcacaatacttgagaagttcctgcatgttagtgttaacttttgatcaagttatttagcattcaaaaataacataataggctcagttggcatagagatgtgtttcatgtggcctatacaatatttttgggtaaaaatgaattctttgtcattatctttaaaaatcgacataaaaacccatattctggcttctcttgaaagtaagttttttttcttttggcagcactaagtcaatacgtgtctacaccacttgtcagggcacactctgttcagtcaccacaccctaacaactctctattacatcactgtgtttgtttgtttgtttgtttgtttgagacagagtctcactctgttggccaggctggagcacagtggcacgatcttggcccactgtaacctctgcctcctcagttcaagtgattctcctgcctcagcctcctgagtagctggtattacaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaac

SEQ ID NO: 349269 - DNA, 3521 bp, Homo sapiens
taagagacaacgtctcactgtgttgcccaggctggtgtcaaactcctgggctcaagggatcttcctgccttggcctcccgaagtgctggaattagaggcatgagccactgcacccagccagcaaacattctcttaatcttttaaagtaaccagtaaatctacaaatagtaaagtactattttcatcagggatttttttttttcttattttctagattttacagaaacaatgtgaaattattttggaaagataaggtaggattcttgaataaatctgaagggtctcacaattaagtgagaaacacctttaaaagcatagtaaagctacacctaaataactaaagcctaaatcattgtaatgttttgttggacttactttaacttgacctgttgtagccacaaataacaaatttcttggtaactgatgctattacagtaggtaatcaaaaatgaaaaattctagtcttatatactgcaggtttggggtgattgttaaggcactatcccctctggagaaatgtcatatggcatcagtgtaaacatgcacaagaaagaatttgtaaaaaaaaatgacaggttaatcaatgaaattagttgtatttactgtttggattttatttagtgtttccttgatgtctgtttcctcatctcttatttgttggaagattacttttctacctcttttttttcttttaaaattcctttcttacatttctgttgtttctttttctagtccttctctatctggataataaaatgaatgacaggaaagtcacccacatagaggtttgggatgaaccttttgcagattgctttttgtttcatacaagtataagatcatattttctttttcaacttagtaataggcaggcttcttggaacaataagtagattgatacactcctccccaaatcaaattatattgtatatcttttatattagatgtttgcagaaattctgtggcctttaagatcagttattcagcctttgtaattatgttatctagctatgttgaaaagataagtgcttactatataagcactcttagaaaaataattaactgattactctttcagaaaatagcaggtgtctcaatgctttttttccataattataaagaccattgtcaaaatctttggtttactaaatatttcactgagcatatatagagatacgttgcttgtggcataaaaagtcttgtagataacttactcacatttggcttttttttaattggtgcattttttaatttgcttttttgaaaattatgaagttaaaatttaattctaaggtagtatttttcatgtataaaactaataatgtagttaagcatactgtttgaataaaattataataaatggcacaattccttaaaccctgaaaataccaagttatattggaaaatagtggaaagaaaaaactagtggagaacatcttagaaaattctattgtggaaattacgatgattattttcagtgagaatgaatttatatatacaacaaaaatatacaaaagctaaccttctcatcctaaaaagatttttccctttgcttctgttttatttagccctgccatgcaccacattaattttatgaacataaatgatatttaacttttcttttttttttttttttgagacagagtctcactccgtcaccaggctggagtgcggtggcgcgatctcagctcactgcaacctccatttcccaggttcaagcaattctcctgcctcagcctcccaagtagctgggattacaggcacgcgccaccacgcccacctaatttttgtatttttagtagagacggggtttcaccatgttggtcaggctggcctcgatctcgtgacctcgtgatctgtccgcctcggccttccaaagtgctaggattacaggcgtgagccaccgcacctggccaacttttcatcttaagttgtttaaatttatgcacttttagatatcagaatatatgcttgaacaaaggaaatagtaaattagctatatgtctgctggtttcacttcgatgtggatatggatatgtggataaagacagtaaatgaaattaaaaccctgctgttttaaatatcattaccagatataattgagggaatattatatcaacaaacatattgaaacttggctttatttgtaacgtaaactatatataatccatacgtagccaaattagatttaaaatatacaattaatgaatagtactcaaagtgtttttgttgcactgttactctgaatatggactctctatatctggtatggcgtgactgggcataacttctgtaatgtatttcagttatatgtttttccttttattgccagcttctgataatgaaattttccaaagggatgagatataagaatcatcttttataaaaaccagtggggagtggggtattataatctagttctaaactgtccatttgctttatataaaggctttgatttcaataactgaccatttgatgaatatttaaattacacagaataatgtctacatagaataaacttaagtattcaagagccttaaagtgaaaaaatgaaccttttgactgccttaaaatactacttgctctgtaattcaggcatactagttactttccttggggtctgtttaaataatgccttaatagtgttctaatgtttctgaaatacagaactcaaagggtcttttagagcttttaattttacatagtgaatggaaatttaagtattacattttaaaacctgattgtacattggtaatttaaacatccaataacaggaaaatctagatacagtgatgtgttatacatacatgactgttaacatcagtaatatttatgatatccaaggaccaagttgcatatttaacatcgaatgaaaatgtagttgtacagttccaaaaataattaattttttaagggaatttttcaagacaaaaggcaaatattttgtttcaaacctacaagcaaattcattccaagaagtgaatatagtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaagtttatttcatttccaaggaaaggaccctgaaaggaggggacagggagcttcctaggtctgttgataaactaactgatgctttgtcaagtcttccaagttttcactgtaaataatacaactaacaatgtaattttgctgttttctaatagagaatgaatgaatatattaatgtattacatttgtttcatgataaaacagttttcactgatactgtgaaatcctttctctcctttctagccttgcaaaataccctactaaataaatcattttagacatggagtgcaggtggacactgtgtgaactgtttttggtcagttattgtagaaattgatagatgtaccaaataaactctatgcacattaaa

SEQ ID NO: 349270 - DNA, 2860 bp, Homo sapiens
ccctcctcagaaaatcaagagaagcagaatccatggcaacccaccaccttccatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaac

SEQ ID NO: 349271 - DNA, 4628 bp, Homo sapiens
taagagacaacgtctcactgtgttgcccaggctggtgtcaaactcctgggctcaagggatcttcctgccttggcctcccgaagtgctggaattagaggcatgagccactgcacccagccagcaaacattctcttaatcttttaaagtaaccagtaaatctacaaatagtaaagtactattttcatcagggatttttttttttcttattttctagattttacagaaacaatgtgaaattattttggaaagataaggtaggattcttgaataaatctgaagggtctcacaattaagtgagaaacacctttaaaagcatagtaaagctacacctaaataactaaagcctaaatcattgtaatgttttgttggacttactttaacttgacctgttgtagccacaaataacaaatttcttggtaactgatgctattacagtaggtaatcaaaaatgaaaaattctagtcttatatactgcaggtttggggtgattgttaaggcactatcccctctggagaaatgtcatatggcatcagtgtaaacatgcacaagaaagaatttgtaaaaaaaaatgacaggttaatcaatgaaattagttgtatttactgtttggattttatttagtgtttccttgatgtctgtttcctcatctcttatttgttggaagattacttttctacctcttttttttcttttaaaattcctttcttacatttctgttgtttctttttctagtccttctctatctggataataaaatgaatgacaggaaagtcacccacatagaggtttgggatgaaccttttgcagattgctttttgtttcatacaagtataagatcatattttctttttcaacttagtaataggcaggcttcttggaacaataagtagattgatacactcctccccaaatcaaattatattgtatatcttttatattagatgtttgcagaaattctgtggcctttaagatcagttattcagcctttgtaattatgttatctagctatgttgaaaagataagtgcttactatataagcactcttagaaaaataattaactgattactctttcagaaaatagcaggtgtctcaatgctttttttccataattataaagaccattgtcaaaatctttggtttactaaatatttcactgagcatatatagagatacgttgcttgtggcataaaaagtcttgtagataacttactcacatttggcttttttttaattggtgcattttttaatttgcttttttgaaaattatgaagttaaaatttaattctaaggtagtatttttcatgtataaaactaataatgtagttaagcatactgtttgaataaaattataataaatggcacaattccttaaaccctgaaaataccaagttatattggaaaatagtggaaagaaaaaactagtggagaacatcttagaaaattctattgtggaaattacgatgattattttcagtgagaatgaatttatatatacaacaaaaatatacaaaagctaaccttctcatcctaaaaagatttttccctttgcttctgttttatttagccctgccatgcaccacattaattttatgaacataaatgatatttaacttttcttttttttttttttttgagacagagtctcactccgtcaccaggctggagtgcggtggcgcgatctcagctcactgcaacctccatttcccaggttcaagcaattctcctgcctcagcctcccaagtagctgggattacaggcacgcgccaccacgcccacctaatttttgtatttttagtagagacggggtttcaccatgttggtcaggctggcctcgatctcgtgacctcgtgatctgtccgcctcggccttccaaagtgctaggattacaggcgtgagccaccgcacctggccaacttttcatcttaagttgtttaaatttatgcacttttagatatcagaatatatgcttgaacaaaggaaatagtaaattagctatatgtctgctggtttcacttcgatgtggatatggatatgtggataaagacagtaaatgaaattaaaaccctgctgttttaaatatcattaccagatataattgagggaatattatatcaacaaacatattgaaacttggctttatttgtaacgtaaactatatataatccatacgtagccaaattagatttaaaatatacaattaatgaatagtactcaaagtgtttttgttgcactgttactctgaatatggactctctatatctggtatggcgtgactgggcataacttctgtaatgtatttcagttatatgtttttccttttattgccagcttctgataatgaaattttccaaagggatgagatataagaatcatcttttataaaaaccagtggggagtggggtattataatctagttctaaactgtccatttgctttatataaaggctttgatttcaataactgaccatttgatgaatatttaaattacacagaataatgtctacatagaataaacttaagtattcaagagccttaaagtgaaaaaatgaaccttttgactgccttaaaatactacttgctctgtaattcaggcatactagttactttccttggggtctgtttaaataatgccttaatagtgttctaatgtttctgaaatacagaactcaaagggtcttttagagcttttaattttacatagtgaatggaaatttaagtattacattttaaaacctgattgtacattggtaatttaaacatccaataacaggaaaatctagatacagtgatgtgttatacatacatgactgttaacatcagtaatattttatgatagtttaaggttttttattgttttctataacaagttatccaacaggttggactttgtaacatgatatccaaggaccaagttgcatatttaacatcgaatgaaaatgtagttgtacagttccaaaaataattaattttttaagggaatttttcaagacaaaaggcaaatattttgtttcaaacctacaagcaaattcattccaagaagtgaatatagtagtaaaacataaagactattgcaataaaaagtttccaggccagtgacttgtttaattacattcacatttttacattcactttgcctttcaaagcaggagtattttataaaactgaaataaaactttaaattgtcaagctggtgcttaaagttatgtaaaatctgatttaagtttatttcatttccaaggaaaggaccctgaaaggaggggacagggagcttcctaggtctgttgataaactaactgatgctttgtcaagtcttccaagttttcactgtaaataatacaactaacaatgtaattttgctgttttctaatagagaatgaatgaatatattaatgtattacatttgtttcatgataaaacagttttcactgatactgtgaaatcctttctctcctttctagccttgcaaaataccctactaaataaatcattttagacatggagtgcaggtggacactgtgtgaactgtttttggtcagttattgtagaaattgatagatgtaccaaataaactctatgcacattaaacaagtgtctgtctatctctttcaagaaatacgaatgttaaggttataatatgccttaaaaaatctaaagcctttagtaatcttgtatttgaacaaggtaaaatttaagttttgataattaatattgaccttttaatgtatctagttttatgtaagtattaaaagtatatgaagttaaagattctttacccatggaattcaattataacaaaatgattagatttaatgaaaacaaattatttaaagttttaaaataggattcttttgtgaaaagatctactcaaaattgcctttggcaaaagttatcatccaaacacaaaaagtcaactatgcaaataaaaacactgtttcagtgccaatttgcagacatttttctcctcaattcccataaaaattttctgaaaagttctaagatctgaactgtgggtaactgaaagcaagttacatcagaatatattcaccaaaacttcaaaacatttggttgattttacagcactcatttcaacacttgtacaagaaggatcacaaattatacatactagatttaataaattttaacaatattaaaccttatgaagaaaacctgactttaaaagatgttgttcaaatggtaattttttatcagtaaacagtaaaatccaggtacagaagatccctttttttcttcaacagcttttcaattacagatattttggcaattaaaatgtaaattgattatctaatgataaagtgaaaaatggcctagttttttatattaatgaactccagtaaacagctcgtatttcagatcttaaaataaagggccgggcattgtggcttacacctgtaatcatagcacttcaggaggccaaaggaggaggactgcttgagcctaggagttcaaaactaaaaagttgtaactatggggatcttgctgggcaacacagtaagacccccatatttacaaaaaactaaaaagaattagttgagcatggtggcatgtgcctgtagccctagctattcagaaggctacggtaggaggatcacttcagcccaggagtttg

SEQ ID NO: 349272 - DNA, 1234 bp, Homo sapiens
cggggcaaaagaagaggggcaggactcgttcccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtgagtgaattatatgttacagcatgtgattaaacatgagtaatttagtgtaggtgctaaaaggataaacttggggtagctatatatttatacttttaaaaagaaattatttaaaatatatcttgaaattgatgtctgtttaaaacacctaccatgatgtccaacatgatgtaggtggcatttgtgttagtttcactccagaaaatctactgccttgctaatta

SEQ ID NO: 349273 - DNA, 1813 bp, Homo sapiens
tgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaaccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtgaggacattgcgggaggccggctgggagccttttgtgcggccccagggacgcgcaaattctgaccagtcctccatgtctctcacccgcatcccaggggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggtaagcataagatcttcattgggaagaagggtgggtaagggatattcaataaatagcaaatttttatttaacat

SEQ ID NO: 349274 - DNA, 3945 bp, Homo sapiens
cggggcaaaagaagaggggcaggactcgttcccgggaaccgaacctggaatccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaac

SEQ ID NO: 349275 - DNA, 3848 bp, Homo sapiens
tgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaaccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaac

SEQ ID NO: 349276 - DNA, 3905 bp, Homo sapiens
ttatccaggaatggattaactgatgaccaggttctgacctcactcactgcccaattgccttctaaaccactgataatggagcttaagctttgaggcaggagatgatggcagttggagaaagaagaaattaagttgctgtatatgtcttgtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaac

SEQ ID NO: 349277 - DNA, 3280 bp, Homo sapiens
tccagctcagccatgtgagatgtctgttcctactttgcctaccaccatgagtaaaagcttcctgaggcctcccaagaagccgagcagatgccagcaccaggcttcctataaagcctgcagaactgacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaac

SEQ ID NO: 349278 - DNA, 2829 bp, Homo sapiens
tgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaaccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggtgaggacattgcgggaggccggctgggagccttttgtgcggccccagggacgcgcaaattctgaccagtcctccatgtctctcacccgcatcccaggggttgaggctgggcaaacgccgcgaaactatcgctcttccccgtcccgcttccgcgcctgtccaccctgggtaacggaaccagcatcgcggtagggacatcctcgctaggcccggccggaccattcctcagggtgggccctttccgaagccgggaccgctcctgcttgtcggcatcgctccccacaggccgacgtcgagagggcctgctttactcctcctctttctcctccttctcccgcggcttctgcgcggagaggcgtcgcccgggatctgggttttggaagaaggatctttgtgggaagacagggtgaatttatcacagaggaataacgagggagaggagaaaggtttcctaaagacaaaaaaaaatggaggaatctgtaaaccaaatgcagccactgaatgagaagcagatagccaattctcaggatggatatgtatggcaagtcactgacatgaatcgactacaccggttcttatgtttcggttctgaaggtgggacttattatatcaaagaacagaagttgggccttgaaaatgctgaagctttaattagattgattgaagatggcagaggatgtgaagtgatacaagaaataaagtcatttagtcaagaaggcagaaccacaaagcaagagcctatgctctttgcacttgccatttgttcccagtgctccgacataagcacaaaacaagcagcatttaaagctgtttctgaagtttgtcgcattcctacccatctctttacttttatccagtttaagaaagatctgaaggaaagcatgaaatgtggcatgtggggtcgtgccctccggaaggctatagcggactggtacaatgagaaaggtggcatggcccttgctctggcagttacaaaatataaacagagaaatggctggtctcacaaagatctattaagattgtcacatcttaaaccttccagtgaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagttgaaccaactggaaaacgtttcttactagctgttgatgtcagtgcttctatgaaccaaagagttttgggtagtatactcaacgctagtacagttgctgcagcaatgtgcatggttgtcacacgaacagaaaaagattcttatgtagttgctttttccgatgaaatggtaccatgtccagtgactacagatatgaccttacaacaggttttaatggctatgagtcagatcccagcaggtggaactgattgctctcttccaatgatctgggctcagaagacaaacacacctgctgatgtcttcattgtattcactgataatgagacctttgctggaggtgtccatcctgctattgctctgagggagtatcgaaagaaaatggatattccagctaaattgattgtttgtggaatgacatcaaatggtttcaccattgcagacccagatgatagagccttgcaaaataccctactaaataaatcattttagacatggagtgcaggtggacactgtgtgaactgtttttggtcagttattgtagaaattgatagatgtaccaaataaactctatgcacattaaa

SEQ ID NO: 349279 - DNA, 2356 bp, Homo sapiens
tggtttcaccattgcagaccagatgatagaggcatgttggatatgtgcggctttgatactggagctctgggggagtatcgaaagaaaatggatattccagctaaattgattgtttgtggaatgacatcaaatggtttcaccattgcagacccagatgatagaggcatgttggatatgtgcggctttgatactggagctctggatgtaattcgaaatttcacattagatatgatttaaccataagcagcagcacgatccagagatccattgccatcagtgatctcactaaaaatatacagctacttcccagctaatctccacccaatgaatgatgatggtatagtatgtgcataatggaaagttaccttactgaaaaaaaaaaaagaaggaaaaataagatgggcccaaaggtctatctactaaactagctcttggggaaatagcttcaggatactgtagtttcctctatctaatagagaactttttgttaacagacactgtaaaatagttttgctttgttgaataatacatgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcactcgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaaggataagtaggagaagctaccacagaaggtaac

SEQ ID NO: 349280 - DNA, 1260 bp, Homo sapiens
  misc_feature (1226)..(1226): n is a, c, g, or t
  misc_feature (1233)..(1233): n is a, c, g, or t
tgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaaccccggcggcagtggggctgttgctgttgctgtggctgtcgctgcccgtcaggctgccttcttttgtcgtttcccagcgctgcgcaggacttctcctggcggcgctgcggatccagggggtcggctgccaggtacaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtatggaaggctttgttacaagaaatgccgcttactgcattactaaggaatctaggaaagatgactgctaattcagtacttgaaccaggaaattcagaagtatctttagtatgtgaaaaactgtgtaatgaaaaactattaaaaaaggctcgtatacatccatttcatattttgatcgcattagaaacttacaagacaggtcatggtctcagagggaaactgaagtggcgccctgatgaagaaattttgaaagcattggatgctgctttttataaaacatttaagacagtggaccactggcgttctactagcngttgagncagtgctctaggaccgagtttgggggt

SEQ ID NO: 349281 - DNA, 757 bp, Homo sapiens
tgaaagaaattaaagatctaaataactggaaaaatatcccatgttcatgtgtcagaggatttaacatcattatatgacaaaattctccaccttgatctacaaattcaatgtcatccctatccaaatccctatcagaataacttctttgtagatattgacaaacgggttctaaaattcatatggaactgaaggggacccagaatagccaagacaatcttgtaaaagatcaagtaggaggactcaccagttttaaaacttactacaaagcaatggcaatcaaaacagtgtcgtactggcacaaggacagacatacacatcaatgtaatacaactgagagtccagatataaatccatacatccacggtcaactcatttttagcaagggtgccaagactgtccaatgggaaagaatagtcttttcaacaaatggtgctgggaaaactggacagccacatacaaatgaatgaagctggaacttagctcacaccatatacaaaactgtctcatcccagcactttgggaggccaaggcagatggatcacaaggtcaggagatcgagaccatcctggccaacatagtgaaaccccatctctactaaaaatacaaaaattagctgggcatggtggtgcatgcctgtaatcccagctacttgggaggctgaggcaggagaatcacttgaaccaaggagtcggaggttgcagtgagccgagatcgcgccactgccctccagcctggcaacagagcaagatgccatcgc

SEQ ID NO: 349282 - DNA, 822 bp, Homo sapiens
gtgaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcaggtgagaatgactgatagcgtgattagcgtagtttcaggtgagaatgactggtaatg

SEQ ID NO: 349283 - DNA, 1098 bp, Homo sapiens
tactacccgacaaccttagcccaaccctttaccccaataaagtataggcgatagaaattgaaacctggcgccatagatatagtaccgcaagggaaagatgaaaaattatagcccagcataatatagccaggactaacccctataccttctgcataatgaattaactaaaaataaaaagcctaaaatatactctaactcttcaaaaaacatttttatgaaagaggaaaggaaggaggccctctttgtggctggaatgctggctctgagcagagtcagggtgacgcggcagggcgctggctttccagctgggtcagcggtcgtgaggctcaacacgagaggaggtggggtggctgctttggttgtaacattagcagggggaagacagctgcttagaagcatggtgggaagcagatgtggtgaagtgccgtactgttctgcttacaaagatggggatgtctaagatcgtgtttactacctgatagcctaaaacagtatcacttgagtcatggactaaaaggaaccttaaacattgtccagcccagcccaggtgtccatctctgttgcactgagacttgtaaggcgtccttgctgcttcgtggcagtgtgccttagctttccaagcaggggtctgaatagctttttccatgaaaattcaggggtctttctttgatacccttgtgacttgtcattcaggggatggcttccactgtttaaggctgaagcctaggtgatctcatagaacagggttcaccaaataaggcccatgggccaatttggccaccacctgttattgtaaataagtttttattggaacatagccgcagccattcaatgacatgcctgtggctgtgtctgcgctactgtagccacagggacctctggtctgcaaagctgaaaacgtttaccgtctgacccttgatagagaaaggctgccagtcgcgccgttgtctaaaaaagtctgaactccaccttagtgttaactagtccataggatggctcgtcgacctgcacgagcgtcataaacacgctggaggaccagagcaggggcggctgtgtctgcaacccggctttccttctgacatcacctggtctctgccc

SEQ ID NO: 349284 - DNA, 1259 bp, Homo sapiens
aggcttgagcccagttccacgggccgcgcccgctgaccccagcgactgccaggtgttcctggcggagggagcatctggacaggggaggctggagagcagccagagcttgggcttggcagggtggccccagggcgacaatcgatgacgctggagaaggggttgggaccgatgtgaaggttttagagcaggggttccccaacccccggtaccgtcccttgcctattaggaaccaggctgcacagcaggaggtgagcggcaagtgagccagccagactgtatttacagccgctcccttcgctggcattaccgcctgagctccgcctcctgtcagaccagccgccttagattctcactggagcgcgaaccctattgtgaactgcgcctttgaggggtccaggttgcgctccttatgagaatctgatgcccgatgatctgtcactgtttcccatcaaccccagatggcacctcctggttgtaggaaaacaagctcagggctcccagtgattctacattatggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaaggggtggagaggaccttaaggggggtgcttactgtggcctgaatttcacctgcgccagggcttacgacctgtcaggtctcaagggaagggccttcaccggcagcagtcgccgattggcagtgccctgttcggaggaccggccgatacagtcgtgttctccggcgggaccccccagagaggttggtccacccatagaattggcggggccgaagagaaacactctggcaaatgggggttgtaacaca

SEQ ID NO: 349285 - DNA, 1001 bp, Homo sapiens
ggacttacaaagttagagtgaacacagggcagtattggcacagatgtatcaaattgacgccgccagaattctacttttatatgtggaattttgatactgacagtgggggaaaaagggactttttagcatgaagagatgaaaaatccagtttacccatatgcataaaaaatgaaattgtagcccaacttctcacacacacacagtctaacagattaatgacctacaggtcaaaagcaaaagatattttttaaagaaggctcccaacttgttaaccactaatgcttgataaatttgattatgaacttttctctattaggaagtaccaccaagaacagggaaggacaagccagaggctggaggaagatacctgcagaacacagacctgacaaaggatcagtatcaaaacatataagaattttgacaaatgaataaaaagagtacaaataacccaacataaagtcaaaaggcgtgatcaggcatttcacagaagcaaacacctttggtggatgcccatgaggagaggcgcagtcacatcagtgcccaggagatgcaaacccagatcccaggggtgtgcatcccacccgttctgcctgtaggatctgcaaacccggcaaaacctagttctagagagactggattcactgcatgtcttcatcactgctggagggagcgcagactgctatcgcctcttagaaaatgacttagttctcatgtaatttgggcattcacacatcctcatcctagatccagcttttccactcccgcacacgtactggaaaacctgtacaggaacatccactgcagcactgctcataccaaacacaacctacatgttctctgcacagagaggggagaagagccggtcagttcactcagtggactctgtgctcaatagtaggtgtgaataagccgcagccgcccagaccgcatgggccaacctcagtccgagaatgcggagtgaaaacacaggtctaacgatcacacatggcaagataattatc

SEQ ID NO: 349286 - DNA, 1060 bp, Homo sapiens
ggacttacaaagttagagtgaacacagggcagtattggcacagatgtatcaaattgacgccgccagaattctacttttatatgtggaattttgatactgacagtgggggaaaaagggactttttagcatgaagagatgaaaaatccagtttacccatatgcataaaaaatgaaattgtagcccaacttctcacacacacacagtctaacagattaatgacctacaggtcaaaagcaaaactttacatctttgtgaaaaaaatatacatgaataactttctaactttggtgtggggaaggatattttttaaagaaggctcccaacttgttaaccactaatgcttgataaatttgattatgaacttttctctattaggaagtaccaccaagaacagggaaggacaagccagaggctggaggaagatacctgcagaacacagacctgacaaaggatcagtatcaaaacatataagaattttgacaaatgaataaaaagagtacaaataacccaacataaagtcaaaaggcgtgatcaggcatttcacagaagcaaacacctttggtggatgcccatgaggagaggcgcagtcacatcagtgcccaggagatgcaaacccagatcccaggggtgtgcatcccacccgttctgcctgtaggatctgcaaacccggcaaaacctagttctagagagactggattcactgcatgtcttcatcactgctggagggagcgcagactgctatcgcctcttagaaaatgacttagttctcatgtaatttgggcattcacacatcctcatcctagatccagcttttccactcccgcacacgtactggaaaacctgtacaggaacatccactgcagcactgctcataccaaacacaacctacatgttctctgcacagagaggggagaagagccggtcagttcactcagtggactctgtgctcaatagtaggtgtgaataagccgcagccgcccagaccgcatgggccaacctcagtccgagaatgcggagtgaaaacacaggtctaacgatcacacatggcaagataattatc

SEQ ID NO: 349287 - DNA, 510 bp, Homo sapiens
ggacttacaaagttagagtgaacacagggcagtattggcacagatgtatcaaattgacgccgccagaattctacttttatatgtggaattttgatactgacagtgggggaaaaagggactttttagcatgaagagatgaaaaatccagtttacccatatgcataaaaaatgaaattgtagcccaacttctcacacacacacagtctaacagattaatgacctacaggtcaaaagcaaaactttacatctttgtgaaaaaaatatacatgaataactttctaactttggtgtggggaaggatattttttaaagaaggctcccaacttgttaaccactaatgcttgataaatttgattatgaacttttctctattaggaagtaccaccaagaacagggaaggacaagccagaggctggaggaagatacctgcagaacacagacctgacaaaggatcagtatcaaaacatataagaattttgacaaatgaataaaaagagtacaaataaccca

SEQ ID NO: 349288 - DNA, 5085 bp, Homo sapiens
  misc_feature (2146)..(2146): n is a, c, g, or t
  misc_feature (2240)..(2240): n is a, c, g, or t
  misc_feature (3226)..(3226): n is a, c, g, or t
gtgaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcntgtcaccttagggaactcaatgagtccgaagaacaatttgaaatgttgggaaaagagaagaggaatttgatgtcagccggggtgatccctgagntagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggtgagctgatacctgagtggggcccttgcctgttgggttctctactggaggacagtgggcacagcaaagattcccttacttgtacctggcagcccacacgcaatggggaaaagggagagtttgtctttattgccttgcttggccataggcaaaactgtttggaaatgagacatttcactgtgccagtgttttcattttctcttccattgtggcatcccggtcactgccaccctccctagaacctaggctgttgttgtacccagtcggaggactaagtagaatcctcagtctgcacttngttagatgatcagtccatcccggtttcattagcagatgggtaattcagcaactcaggattgcttctttcattttgatacagaaatctttatgctcctgacagttttctgattctattattactaatttccttgggtggactttgagtattttcaaggaagccatttgagtttttaaaagaagccacatgggaaaagctgtggtggcctctttggaatgtttcaagaacgaactgtaattcctgagcaccaggaagtctttttacttgatatttaatgtggaaaacatcccaatgggcaagtcctgtgacagcacttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggctgaggggcttgaggtcctagtagggagtagaaagtttcctagtaggattcacctacttttccagtgatatcactcgatcttagcatctgctagtaatgctgtagcttacatggacaaacagtgacaggtcccagggcggcaggaagtccgcagtacgcgtttgtgaacgtggtttctctcagttcacccagtgacccttcgctgagctcgagacccttcattgagctccaccttctgctctcaagtgggtctggagcctggggaacagctcgggagtacaggtgaaacttctcgaattgcctgttccttctttctgaaaatgacaaattgcagaatacacagacacatgcacatgaaattttaataaagataaaaagcctaaaatatactctaactcttcaaaaaacatttttatgaaagaggaaaggaaggaggccctctttgtggctggaatgctggctctgagcagagtcagggtgacgcggcagggcgctggctttccagctgggtcagcggtcgtgaggctcaacacgagaggaggtggggtggctgctttggttgtaacattagcagggggaagacagctgcttagaagcatggtgggaagcagatgtggtgaagtgccgtactgttctgcttacaaagatggggatgtctaagatcgtgtttactacctgatagcctaaaacagtatcacttgagtcatggactaaaaggaaccttaaacattgtccagcccagcccaggtgtccatctctgttgcactgagacttgtaaggcgtccttgctgcttcgtggcagtgtgccttagctttccaagcaggggtctgaatagctttttccatgaaaattcaggggtctttctttgatacccttgtgacttgtcattcaggggatggcttccactgtttaaggctgaagcctaggtgatctcatagaacagggttcaccaaataaggcccatgggccaatttggccaccacctgttattgtaaataagtttttattggaacatagccgcagccattcaatgacatgcctgtggctgtgtctgcgctactgtagccacagggacctctggtctgcaaagctgaaaacgtttaccgtctgacccttgatagagaaaggctgccagtcgcgccgttgtctaaaaaagtctgaactccaccttagtgttaactagtccataggatggctcgtcgacctgcacgagcgtcataaacacgctggaggaccagagcaggggcggctgtgtctgcaacccggctttccttctgacatcacctggtctctgccc

SEQ ID NO: 349289 - DNA, 5205 bp, Homo sapiens
  misc_feature (2146)..(2146): n is a, c, g, or t
  misc_feature (2240)..(2240): n is a, c, g, or t
gtgaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcntgtcaccttagggaactcaatgagtccgaagaacaatttgaaatgttgggaaaagagaagaggaatttgatgtcagccggggtgatccctgagntagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggtcagtatgaaactggtaacaggttgtagatggctttctatggtatatcccagtctcttgcaaacgattgtgaagaatgccagtgttgtttaagattcggcagtttgtgtggggaggtgggggcaggatggggtttggttgccaaaagagtttgggaaatgctggcttaaacaaaggcgagaggaagttcctttcacgtcaggatttatgaatgcctatgagcccagtgtcagtgacgactttctagcggcggtcttcaacactttctaaatattaagcgatcaaggcccctgccccacttttagttccaacagaatgccgttcacaagatctgggaggcactctctcagccctctcctggagcccccggaatttctcagcagcccaggccctcccgctgcccgtggcccctcctcccaggtgccaggtggtcttccagcctctccaagggcccacccccctgcctcttcctcccactgcagctgatctaggggtttcttggccacatttcccttgagagagagtgggatttgccctatccacagagagcctcatttccacctgaaggtgtatttgtcagtggctagaccaggttcatgtctgtttccccttggggacttctgaaccttcctgcccgggagtctgtaacacagcagcacaggaccgcgcttcctttagcagtgctgagtaagcaggcagcggcactctgagatcccggggctgggcagtcgccccccacttcccagcagctctgtggtagtggggcgggagcagcagggacgtaccttaagatttctccagtgtctgactcttactttgtttcctgaaataattagagaaaagtcgtttaatgaaaaagagactgtgtaccttgaattctacagctacctcagtccaggctgcctgctgagatcctgtctttagctcacatacattccacggtgggggacaccattagtccagacaccgctgtggagattagcattttagtttgtgtgcgcccgcctggcttgaggcagtagtttaggaatgacaaggctagaaacctggctggctgtgagtcagagagagagaggatggacgtgggagaaagcaagcaaaagctaccctagggaagagccggtgacgtgcacaggccgagcagcacggctggtgagctgcaggctgcggccttgcccggacacttggtaatgccaaacaagtacgtgtggctactcattggtctatgaggacgatgacaggcttcgactctgtggtttctaaagcatataatattctcacgtacttctttcagcaaacgccaaacagtagtaattcttgtaactaccttgaaccctttgtggaaagaacctgggtgtgagtgaataaaaagtaaagagcgacgcgctatatcggccattaaatactcggggctgtccgtaacaccctgtgcttcccaattgtagcaccatgttctgtgtgaatatgcataaccagagtgaccccccccagcacccagcatgcccggctgtgcccctctgggtatgctcacatgcacatatatggacatacagtttcgtagcagaacgtggctgcccaggggctgcctatctgggcgagtagaccgcctggctcagcccacaggcctgcagcatcccatagcaccccgcccttgccccatcaccctgtgggctacatgcaggacacggcatgggcctgctccccagaggcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtg

SEQ ID NO: 349290 - DNA, 5067 bp, Homo sapiens
  misc_feature (27)..(27): n is a, c, g, or t
  misc_feature (2128)..(2128): n is a, c, g, or t
  misc_feature (2222)..(2222): n is a, c, g, or t
  misc_feature (3208)..(3208): n is a, c, g, or t
agaaaagtatgtaaaaaaagaggaggnacggtccggaattccgggatgctgcgttcggccgtaagtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcntgtcaccttagggaactcaatgagtccgaagaacaatttgaaatgttgggaaaagagaagaggaatttgatgtcagccggggtgatccctgagntagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggtgagctgatacctgagtggggcccttgcctgttgggttctctactggaggacagtgggcacagcaaagattcccttacttgtacctggcagcccacacgcaatggggaaaagggagagtttgtctttattgccttgcttggccataggcaaaactgtttggaaatgagacatttcactgtgccagtgttttcattttctcttccattgtggcatcccggtcactgccaccctccctagaacctaggctgttgttgtacccagtcggaggactaagtagaatcctcagtctgcacttngttagatgatcagtccatcccggtttcattagcagatgggtaattcagcaactcaggattgcttctttcattttgatacagaaatctttatgctcctgacagttttctgattctattattactaatttccttgggtggactttgagtattttcaaggaagccatttgagtttttaaaagaagccacatgggaaaagctgtggtggcctctttggaatgtttcaagaacgaactgtaattcctgagcaccaggaagtctttttacttgatatttaatgtggaaaacatcccaatgggcaagtcctgtgacagcacttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggctgaggggcttgaggtcctagtagggagtagaaagtttcctagtaggattcacctacttttccagtgatatcactcgatcttagcatctgctagtaatgctgtagcttacatggacaaacagtgacaggtcccagggcggcaggaagtccgcagtacgcgtttgtgaacgtggtttctctcagttcacccagtgacccttcgctgagctcgagacccttcattgagctccaccttctgctctcaagtgggtctggagcctggggaacagctcgggagtacaggtgaaacttctcgaattgcctgttccttctttctgaaaatgacaaattgcagaatacacagacacatgcacatgaaattttaataaagataaaaagcctaaaatatactctaactcttcaaaaaacatttttatgaaagaggaaaggaaggaggccctctttgtggctggaatgctggctctgagcagagtcagggtgacgcggcagggcgctggctttccagctgggtcagcggtcgtgaggctcaacacgagaggaggtggggtggctgctttggttgtaacattagcagggggaagacagctgcttagaagcatggtgggaagcagatgtggtgaagtgccgtactgttctgcttacaaagatggggatgtctaagatcgtgtttactacctgatagcctaaaacagtatcacttgagtcatggactaaaaggaaccttaaacattgtccagcccagcccaggtgtccatctctgttgcactgagacttgtaaggcgtccttgctgcttcgtggcagtgtgccttagctttccaagcaggggtctgaatagctttttccatgaaaattcaggggtctttctttgatacccttgtgacttgtcattcaggggatggcttccactgtttaaggctgaagcctaggtgatctcatagaacagggttcaccaaataaggcccatgggccaatttggccaccacctgttattgtaaataagtttttattggaacatagccgcagccattcaatgacatgcctgtggctgtgtctgcgctactgtagccacagggacctctggtctgcaaagctgaaaacgtttaccgtctgacccttgatagagaaaggctgccagtcgcgccgttgtctaaaaaagtctgaactccaccttagtgttaactagtccataggatggctcgtcgacctgcacgagcgtcataaacacgctggaggaccagagcaggggcggctgtgtctgcaacccggctttccttctgacatcacctggtctctgccc

SEQ ID NO: 349291 - DNA, 5519 bp, Homo sapiens
  misc_feature (2580)..(2580): n is a, c, g, or t
  misc_feature (2674)..(2674): n is a, c, g, or t
  misc_feature (3660)..(3660): n is a, c, g, or t
aggcttgagcccagttccacgggccgcgcccgctgaccccagcgactgccaggtgttcctggcggagggagcatctggacaggggaggctggagagcagccagagcttgggcttggcagggtggccccagggcgacaatcgatgacgctggagaaggggttgggaccgatgtgaaggttttagagcaggggttccccaacccccggtaccgtcccttgcctattaggaaccaggctgcacagcaggaggtgagcggcaagtgagccagccagactgtatttacagccgctcccttcgctggcattaccgcctgagctccgcctcctgtcagaccagccgccttagattctcactggagcgcgaaccctattgtgaactgcgcctttgaggggtccaggttgcgctccttatgagaatctgatgcccgatgatctgtcactgtttcccatcaaccccagatggcacctcctggttgtaggaaaacaagctcagggctcccagtgattctacattatggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcntgtcaccttagggaactcaatgagtccgaagaacaatttgaaatgttgggaaaagagaagaggaatttgatgtcagccggggtgatccctgagntagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggtgagctgatacctgagtggggcccttgcctgttgggttctctactggaggacagtgggcacagcaaagattcccttacttgtacctggcagcccacacgcaatggggaaaagggagagtttgtctttattgccttgcttggccataggcaaaactgtttggaaatgagacatttcactgtgccagtgttttcattttctcttccattgtggcatcccggtcactgccaccctccctagaacctaggctgttgttgtacccagtcggaggactaagtagaatcctcagtctgcacttngttagatgatcagtccatcccggtttcattagcagatgggtaattcagcaactcaggattgcttctttcattttgatacagaaatctttatgctcctgacagttttctgattctattattactaatttccttgggtggactttgagtattttcaaggaagccatttgagtttttaaaagaagccacatgggaaaagctgtggtggcctctttggaatgtttcaagaacgaactgtaattcctgagcaccaggaagtctttttacttgatatttaatgtggaaaacatcccaatgggcaagtcctgtgacagcacttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggctgaggggcttgaggtcctagtagggagtagaaagtttcctagtaggattcacctacttttccagtgatatcactcgatcttagcatctgctagtaatgctgtagcttacatggacaaacagtgacaggtcccagggcggcaggaagtccgcagtacgcgtttgtgaacgtggtttctctcagttcacccagtgacccttcgctgagctcgagacccttcattgagctccaccttctgctctcaagtgggtctggagcctggggaacagctcgggagtacaggtgaaacttctcgaattgcctgttccttctttctgaaaatgacaaattgcagaatacacagacacatgcacatgaaattttaataaagataaaaagcctaaaatatactctaactcttcaaaaaacatttttatgaaagaggaaaggaaggaggccctctttgtggctggaatgctggctctgagcagagtcagggtgacgcggcagggcgctggctttccagctgggtcagcggtcgtgaggctcaacacgagaggaggtggggtggctgctttggttgtaacattagcagggggaagacagctgcttagaagcatggtgggaagcagatgtggtgaagtgccgtactgttctgcttacaaagatggggatgtctaagatcgtgtttactacctgatagcctaaaacagtatcacttgagtcatggactaaaaggaaccttaaacattgtccagcccagcccaggtgtccatctctgttgcactgagacttgtaaggcgtccttgctgcttcgtggcagtgtgccttagctttccaagcaggggtctgaatagctttttccatgaaaattcaggggtctttctttgatacccttgtgacttgtcattcaggggatggcttccactgtttaaggctgaagcctaggtgatctcatagaacagggttcaccaaataaggcccatgggccaatttggccaccacctgttattgtaaataagtttttattggaacatagccgcagccattcaatgacatgcctgtggctgtgtctgcgctactgtagccacagggacctctggtctgcaaagctgaaaacgtttaccgtctgacccttgatagagaaaggctgccagtcgcgccgttgtctaaaaaagtctgaactccaccttagtgttaactagtccataggatggctcgtcgacctgcacgagcgtcataaacacgctggaggaccagagcaggggcggctgtgtctgcaacccggctttccttctgacatcacctggtctctgccc

SEQ ID NO: 349292 - DNA, 3306 bp, Homo sapiens
  misc_feature (2146)..(2146): n is a, c, g, or t
  misc_feature (2240)..(2240): n is a, c, g, or t
gtgaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcntgtcaccttagggaactcaatgagtccgaagaacaatttgaaatgttgggaaaagagaagaggaatttgatgtcagccggggtgatccctgagntagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggaagtaccaccaagaacagggaaggacaagccagaggctggaggaagatacctgcagaacacagacctgacaaaggatcagtatcaaaacatataagaattttgacaaatgaataaaaagagtacaaataaccca

SEQ ID NO: 349293 - DNA, 3856 bp, Homo sapiens
  misc_feature (2146)..(2146): n is a, c, g, or t
  misc_feature (2240)..(2240): n is a, c, g, or t
gtgaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcntgtcaccttagggaactcaatgagtccgaagaacaatttgaaatgttgggaaaagagaagaggaatttgatgtcagccggggtgatccctgagntagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggaagtaccaccaagaacagggaaggacaagccagaggctggaggaagatacctgcagaacacagacctgacaaaggatcagtatcaaaacatataagaattttgacaaatgaataaaaagagtacaaataacccaacataaagtcaaaaggcgtgatcaggcatttcacagaagcaaacacctttggtggatgcccatgaggagaggcgcagtcacatcagtgcccaggagatgcaaacccagatcccaggggtgtgcatcccacccgttctgcctgtaggatctgcaaacccggcaaaacctagttctagagagactggattcactgcatgtcttcatcactgctggagggagcgcagactgctatcgcctcttagaaaatgacttagttctcatgtaatttgggcattcacacatcctcatcctagatccagcttttccactcccgcacacgtactggaaaacctgtacaggaacatccactgcagcactgctcataccaaacacaacctacatgttctctgcacagagaggggagaagagccggtcagttcactcagtggactctgtgctcaatagtaggtgtgaataagccgcagccgcccagaccgcatgggccaacctcagtccgagaatgcggagtgaaaacacaggtctaacgatcacacatggcaagataattatc

SEQ ID NO: 349294 - DNA, 2515 bp, Homo sapiens
gtgaaggacgggggaggaccgctgcttccggcgccgtaactgctgccatcttctccgcgctatggctgcgttcggccgtcagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggtcagtatgaaactggtaacaggttgtagatggctttctatggtatatcccagtctcttgcaaacgattgtgaagaatgccagtgttgtttaagattcggcagtttgtgtggggaggtgggggcaggatggggtttggttgccaaaagagtttgggaaatgctggcttaaacaaaggcgagaggaagttcctttcacgtcaggatttatgaatgcctatgagcccagtgtcagtgacgactttctagcggcggtcttcaacactttctaaatattaagcgatcaaggcccctgccccacttttagttccaacagaatgccgttcacaagatctgggaggcactctctcagccctctcctggagcccccggaatttctcagcagcccaggccctcccgctgcccgtggcccctcctcccaggtgccaggtggtcttccagcctctccaagggcccacccccctgcctcttcctcccactgcagctgatctaggggtttcttggccacatttcccttgagagagagtgggatttgccctatccacagagagcctcatttccacctgaaggtgtatttgtcagtggctagaccaggttcatgtctgtttccccttggggacttctgaaccttcctgcccgggagtctgtaacacagcagcacaggaccgcgcttcctttagcagtgctgagtaagcaggcagcggcactctgagatcccggggctgggcagtcgccccccacttcccagcagctctgtggtagtggggcgggagcagcagggacgtaccttaagatttctccagtgtctgactcttactttgtttcctgaaataattagagaaaagtcgtttaatgaaaaagagactgtgtaccttgaattctacagctacctcagtccaggctgcctgctgagatcctgtctttagctcacatacattccacggtgggggacaccattagtccagacaccgctgtggagattagcattttagtttgtgtgcgcccgcctggcttgaggcagtagtttaggaatgacaaggctagaaacctggctggctgtgagtcagagagagagaggatggacgtgggagaaagcaagcaaaagctaccctagggaagagccggtgacgtgcacaggccgagcagcacggctggtgagctgcaggctgcggccttgcccggacacttggtaatgccaaacaagtacgtgtggctactcattggtctatgaggacgatgacaggcttcgactctgtggtttctaaagcatataatattctcacgtacttctttcagcaaacgccaaacagtagtaattcttgtaactaccttgaaccctttgtggaaagaacctgggtgtgagtgaataaaaagtaaagagcgacgcgctatatcggccattaaatactcggggctgtccgtaacaccctgtgcttcccaattgtagcaccatgttctgtgtgaatatgcataaccagagtgaccccccccagcacccagcatgcccggctgtgcccctctgggtatgctcacatgcacatatatggacatacagtttcgtagcagaacgtggctgcccaggggctgcctatctgggcgagtagaccgcctggctcagcccacaggcctgcagcatcccatagcaccccgcccttgccccatcaccctgtgggctacatgcaggacacggcatgggcctgctccccagaggcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtg

SEQ ID NO: 349295 - DNA, 801 bp, Homo sapiens
gtgaaggacgggggaggaccgctgcttccggcgccgtaactgctgccatcttctccgcgctatggctgcgttcggccgtcagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggaagtaccaccaagaacagggaaggacaagccagaggctggaggaagatacctgcagaacacagacctgacaaaggatcagtatcaaaacatataagaattttgacaaatgaataaaaagagtacaaataaccca

SEQ ID NO: 349296 - DNA, 1166 bp, Homo sapiens
acccccccgactagcccgacaggattccaggctgcctgctgagatcctgtctttagctcacatacattccacggtgggggacaccattagtccagacaccgctgtggagattagcattttagtttgtgtgcgcccgcctggcttgaggcagtagtttaggaatgacaaggctagaaacctggctggctgtgagtcagagagagagaggatggacgtgggagaaagcaagcaaaagctaccctagggaagagccggtgacgtgcacaggccgagcagcacggctggtgagctgcaggctgcggccttgcccggacacttggtaatgccaaacaagtacgtgtggctactcattggtctatgaggacgatgacaggcttcgactctgtggtttctaaagcatataatattctcacgtacttctttcagcaaacgccaaacagtagtaattcttgtaactaccttgaaccctttgtggaaagaacctgggtgtgagtgaataaaaagtaaagagcgacgcgctatatcggccattaaatactcggggctgtccgtaacaccctgtgcttcccaattgtagcaccatgttctgtgtgaatatgcataaccagagtgaccccccccagcacccagcatgcccggctgtgcccctctgggtatgctcacatgcacatatatggacatacagtttcgtagcagaacgtggctgcccaggggctgcctatctgggcgagtagaccgcctggctcagcccacaggcctgcagcatcccatagcaccccgcccttgccccatcaccctgtgggctacatgcaggacacggcatgggcctgctccccagaggcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtg

SEQ ID NO: 349297 - DNA, 1166 bp, Homo sapiens
gtgaaggacgggggaggaccgctgcttccggcgccgtaactgctgccatcttctccgcgctatggctgcgttcggccgtcagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggaagtaccaccaagaacagggaaggacaagccagaggctggaggaagatacctgcagaacacagacctgacaaaggatcagtatcaaaacatataagaattttgacaaatgaataaaaagagtacaaataacccaacataaagtcaaaaggcgtgatcaggcatttcacagaagcaaacacctttggtggatgcccatgaggagaggcgcagtcacatcagtgcccaggagatgcaaacccagatcccaggggtgtgcatcccacccgttctgcctgtaggatctgcaaacccggcaaaacctagttctagagagactggattcactgcatgtcttcatcactgctggagggagcgcagactgctatcgcctcttagaaaatgacttagttctcatgtaatttgggcattcacacatcctcatcctagatccagcttttccactcccgcacacgtactggaaaacctgtacaggaacatccactgcagcactgctcataccaaacacaacctacatgttctctgcacagagaggggagaagagccggtcagttcactcagtggactctgtgctcaatagtaggtgtgaataagccgcagccgcccagaccgcatgggccaacctcagtccgagaatgcggagtgaaaacacaggtctaacgatcacacatggcaagataattatc

SEQ ID NO: 349298 - DNA, 701 bp, Homo sapiens
ggctaggtacgagctgggtttgaatcggccgaggctgtgcatcttctccgcgctatggctgcgttcggccgtcgtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagaaggtacaagaagttgcagattttggctgggtgcggtggctcatgcctgtaatcccagatctttgggaggccgaggcaggcagatcacttgaggtcaggggttcaagatcagcctggccaacatggtga

SEQ ID NO: 349299 - DNA, 5377 bp, Homo sapiens
  misc_feature (2146)..(2146): n is a, c, g, or t
  misc_feature (2240)..(2240): n is a, c, g, or t
gtgaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcntgtcaccttagggaactcaatgagtccgaagaacaatttgaaatgttgggaaaagagaagaggaatttgatgtcagccggggtgatccctgagntagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggagagtgtactccttctacttatgaaaaaaagttaactataaaatggcctcaggcaggtccttcaggaggtttccagaagaaggcatcattgtcacaggaggtggcagctccatgtgtgttactgggacacgatgtggaagtggaagaaggtgacatggatgatcctgcccctgtgactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggtcagtatgaaactggtaacaggttgtagatggctttctatggtatatcccagtctcttgcaaacgattgtgaagaatgccagtgttgtttaagattcggcagtttgtgtggggaggtgggggcaggatggggtttggttgccaaaagagtttgggaaatgctggcttaaacaaaggcgagaggaagttcctttcacgtcaggatttatgaatgcctatgagcccagtgtcagtgacgactttctagcggcggtcttcaacactttctaaatattaagcgatcaaggcccctgccccacttttagttccaacagaatgccgttcacaagatctgggaggcactctctcagccctctcctggagcccccggaatttctcagcagcccaggccctcccgctgcccgtggcccctcctcccaggtgccaggtggtcttccagcctctccaagggcccacccccctgcctcttcctcccactgcagctgatctaggggtttcttggccacatttcccttgagagagagtgggatttgccctatccacagagagcctcatttccacctgaaggtgtatttgtcagtggctagaccaggttcatgtctgtttccccttggggacttctgaaccttcctgcccgggagtctgtaacacagcagcacaggaccgcgcttcctttagcagtgctgagtaagcaggcagcggcactctgagatcccggggctgggcagtcgccccccacttcccagcagctctgtggtagtggggcgggagcagcagggacgtaccttaagatttctccagtgtctgactcttactttgtttcctgaaataattagagaaaagtcgtttaatgaaaaagagactgtgtaccttgaattctacagctacctcagtccaggctgcctgctgagatcctgtctttagctcacatacattccacggtgggggacaccattagtccagacaccgctgtggagattagcattttagtttgtgtgcgcccgcctggcttgaggcagtagtttaggaatgacaaggctagaaacctggctggctgtgagtcagagagagagaggatggacgtgggagaaagcaagcaaaagctaccctagggaagagccggtgacgtgcacaggccgagcagcacggctggtgagctgcaggctgcggccttgcccggacacttggtaatgccaaacaagtacgtgtggctactcattggtctatgaggacgatgacaggcttcgactctgtggtttctaaagcatataatattctcacgtacttctttcagcaaacgccaaacagtagtaattcttgtaactaccttgaaccctttgtggaaagaacctgggtgtgagtgaataaaaagtaaagagcgacgcgctatatcggccattaaatactcggggctgtccgtaacaccctgtgcttcccaattgtagcaccatgttctgtgtgaatatgcataaccagagtgaccccccccagcacccagcatgcccggctgtgcccctctgggtatgctcacatgcacatatatggacatacagtttcgtagcagaacgtggctgcccaggggctgcctatctgggcgagtagaccgcctggctcagcccacaggcctgcagcatcccatagcaccccgcccttgccccatcaccctgtgggctacatgcaggacacggcatgggcctgctccccagaggcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtg

SEQ ID NO: 349300 - DNA, 5104 bp, Homo sapiens
  misc_feature (2165)..(2165): n is a, c, g, or t
  misc_feature (2259)..(2259): n is a, c, g, or t
  misc_feature (3245)..(3245): n is a, c, g, or t
gtgtggaaccaaggcagtaagtactctggctcagaagtcttatggtgtccattacactggaatagtgaggaattaattgtcttttggtcctgtgtcttacagtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcntgtcaccttagggaactcaatgagtccgaagaacaatttgaaatgttgggaaaagagaagaggaatttgatgtcagccggggtgatccctgagntagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggtgagctgatacctgagtggggcccttgcctgttgggttctctactggaggacagtgggcacagcaaagattcccttacttgtacctggcagcccacacgcaatggggaaaagggagagtttgtctttattgccttgcttggccataggcaaaactgtttggaaatgagacatttcactgtgccagtgttttcattttctcttccattgtggcatcccggtcactgccaccctccctagaacctaggctgttgttgtacccagtcggaggactaagtagaatcctcagtctgcacttngttagatgatcagtccatcccggtttcattagcagatgggtaattcagcaactcaggattgcttctttcattttgatacagaaatctttatgctcctgacagttttctgattctattattactaatttccttgggtggactttgagtattttcaaggaagccatttgagtttttaaaagaagccacatgggaaaagctgtggtggcctctttggaatgtttcaagaacgaactgtaattcctgagcaccaggaagtctttttacttgatatttaatgtggaaaacatcccaatgggcaagtcctgtgacagcacttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggctgaggggcttgaggtcctagtagggagtagaaagtttcctagtaggattcacctacttttccagtgatatcactcgatcttagcatctgctagtaatgctgtagcttacatggacaaacagtgacaggtcccagggcggcaggaagtccgcagtacgcgtttgtgaacgtggtttctctcagttcacccagtgacccttcgctgagctcgagacccttcattgagctccaccttctgctctcaagtgggtctggagcctggggaacagctcgggagtacaggtgaaacttctcgaattgcctgttccttctttctgaaaatgacaaattgcagaatacacagacacatgcacatgaaattttaataaagataaaaagcctaaaatatactctaactcttcaaaaaacatttttatgaaagaggaaaggaaggaggccctctttgtggctggaatgctggctctgagcagagtcagggtgacgcggcagggcgctggctttccagctgggtcagcggtcgtgaggctcaacacgagaggaggtggggtggctgctttggttgtaacattagcagggggaagacagctgcttagaagcatggtgggaagcagatgtggtgaagtgccgtactgttctgcttacaaagatggggatgtctaagatcgtgtttactacctgatagcctaaaacagtatcacttgagtcatggactaaaaggaaccttaaacattgtccagcccagcccaggtgtccatctctgttgcactgagacttgtaaggcgtccttgctgcttcgtggcagtgtgccttagctttccaagcaggggtctgaatagctttttccatgaaaattcaggggtctttctttgatacccttgtgacttgtcattcaggggatggcttccactgtttaaggctgaagcctaggtgatctcatagaacagggttcaccaaataaggcccatgggccaatttggccaccacctgttattgtaaataagtttttattggaacatagccgcagccattcaatgacatgcctgtggctgtgtctgcgctactgtagccacagggacctctggtctgcaaagctgaaaacgtttaccgtctgacccttgatagagaaaggctgccagtcgcgccgttgtctaaaaaagtctgaactccaccttagtgttaactagtccataggatggctcgtcgacctgcacgagcgtcataaacacgctggaggaccagagcaggggcggctgtgtctgcaacccggctttccttctgacatcacctggtctctgccc

SEQ ID NO: 349301 - DNA, 4586 bp, Homo sapiens
  misc_feature (1647)..(1647): n is a, c, g, or t
  misc_feature (1741)..(1741): n is a, c, g, or t
  misc_feature (2727)..(2727): n is a, c, g, or t
gtgaaggacgggggaggaccgctgcttccggcgccgtaactgctgccatcttctccgcgctatggctgcgttcggccgtcagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagtatgcatacttcaggatgggaattaagcatccagacattgtaaagagtgagtacttgcagtattcactaaccaagattaagcagagacacatttacctggagcgcctgggacggtaccaaacccctgataagaaggggcagacacagatccctaacccattgctcaaggacattctcagagtttcagaagctgagtttttggccaggacagcctgtacttctgttgaggagtttcaagtttttaagaagctcctggctcgggaggaggaggagtctgagagcagcacatctgatgacaaaagggcaagtctggatgaggatgaggatgacgatgatgaggaggacaatgatgaggatgacaatgatgaggatgacgatgatgaggacgacgacgaggcggaggacaatgatgaggatgaggacgacgacgaggaggaatagctgtgatggaaggactagagcgaaagggcccagagatatcaaggaagcttttcattctcttaaagcttttgggtcctttacttgaatcttctcaagttattttttattctaaaactggtctcttgatgaaaaaaattataagtcacctgagaggcagacagatcaaaccaaacaggaaacaggaaatgcatgtttgatctgttgtcacgtgtctgtggggagggccctgtcccatcctgaataagatacttatgttgagctattcacatcaaggggactcaatatatcaacaattggttttatttttttctcttttgaatatgttggtgataattccgtgacagttggaagatggggttcattcttccggttcaggaatcactatgtatttccttcttgtgataaaaataaaattacgagaaggcaatgtgaggttttagtacatcatagcactttattttatgaaaacatgtagcagattttccacaaaaatgcttatttttaatccaaaagtatattgcttcataatggtattcagtgcacagcagagtaaaagaagttaattcatgatgtactggttaattttgcatggcttcttaaggccagcaaaatgctggcagttttctttatctttgtgaagaacaggcccttcctgtttggggaagttggcttttatgtcagctcttggccagtggtcacttccaagcctggtgtctccggccctgtagtctgtagtgccagactgtgctggcctggagagtgctggggcaggtggaggccagggaatggtcccatacagttatctcccctgccctggttacagacagcttcgagaaccagaggagaagagcatagggtcatggagcaggtgggctgaagccagggccacagggagcaatccgtgaccccccaaggtgggtgtgggggggggggggggcntgtcaccttagggaactcaatgagtccgaagaacaatttgaaatgttgggaaaagagaagaggaatttgatgtcagccggggtgatccctgagntagaggcctgtctctgatggcatgagctctaagagggtcctggaggattggtacatcctagaacattccagttagccctcttttaggggaaactggcataggattgatgcagaaggcatttttgatgatgggaccaaaattcaagtctccttggtagcattctaggatcaactagatcctaggatctggtagattgtaggattctagtgggtagaggccaggggtgctgtgaaacatcctgcagtgcacaggatggtcccacaagagaggatgatccggcccagaatgtcagtgctgagcctgagaaactcatctaaggcctggtccacaacagtaatgtgactgttcactcgtgacaacttcagatggtaaatggacttaggatcgtattattttatttaaaagaaaaataaggagctggtttttcagccgggttcctttcccctatgcactggaatacccctggtaggtgtgagctgcatgcaattgtggggattcagcactgaaatctaggtgcttttgttttctccagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggtgagctgatacctgagtggggcccttgcctgttgggttctctactggaggacagtgggcacagcaaagattcccttacttgtacctggcagcccacacgcaatggggaaaagggagagtttgtctttattgccttgcttggccataggcaaaactgtttggaaatgagacatttcactgtgccagtgttttcattttctcttccattgtggcatcccggtcactgccaccctccctagaacctaggctgttgttgtacccagtcggaggactaagtagaatcctcagtctgcacttngttagatgatcagtccatcccggtttcattagcagatgggtaattcagcaactcaggattgcttctttcattttgatacagaaatctttatgctcctgacagttttctgattctattattactaatttccttgggtggactttgagtattttcaaggaagccatttgagtttttaaaagaagccacatgggaaaagctgtggtggcctctttggaatgtttcaagaacgaactgtaattcctgagcaccaggaagtctttttacttgatatttaatgtggaaaacatcccaatgggcaagtcctgtgacagcacttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggcaccaagcttgggactcaggagccagttcttgttgacacaaggcttctaagctaacactggagcatattagcatttgctgtgtggctgaggggcttgaggtcctagtagggagtagaaagtttcctagtaggattcacctacttttccagtgatatcactcgatcttagcatctgctagtaatgctgtagcttacatggacaaacagtgacaggtcccagggcggcaggaagtccgcagtacgcgtttgtgaacgtggtttctctcagttcacccagtgacccttcgctgagctcgagacccttcattgagctccaccttctgctctcaagtgggtctggagcctggggaacagctcgggagtacaggtgaaacttctcgaattgcctgttccttctttctgaaaatgacaaattgcagaatacacagacacatgcacatgaaattttaataaagataaaaagcctaaaatatactctaactcttcaaaaaacatttttatgaaagaggaaaggaaggaggccctctttgtggctggaatgctggctctgagcagagtcagggtgacgcggcagggcgctggctttccagctgggtcagcggtcgtgaggctcaacacgagaggaggtggggtggctgctttggttgtaacattagcagggggaagacagctgcttagaagcatggtgggaagcagatgtggtgaagtgccgtactgttctgcttacaaagatggggatgtctaagatcgtgtttactacctgatagcctaaaacagtatcacttgagtcatggactaaaaggaaccttaaacattgtccagcccagcccaggtgtccatctctgttgcactgagacttgtaaggcgtccttgctgcttcgtggcagtgtgccttagctttccaagcaggggtctgaatagctttttccatgaaaattcaggggtctttctttgatacccttgtgacttgtcattcaggggatggcttccactgtttaaggctgaagcctaggtgatctcatagaacagggttcaccaaataaggcccatgggccaatttggccaccacctgttattgtaaataagtttttattggaacatagccgcagccattcaatgacatgcctgtggctgtgtctgcgctactgtagccacagggacctctggtctgcaaagctgaaaacgtttaccgtctgacccttgatagagaaaggctgccagtcgcgccgttgtctaaaaaagtctgaactccaccttagtgttaactagtccataggatggctcgtcgacctgcacgagcgtcataaacacgctggaggaccagagcaggggcggctgtgtctgcaacccggctttccttctgacatcacctggtctctgccc

SEQ ID NO: 349302 - DNA, 3199 bp, Homo sapiens
gtgaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttctttgttgcgcaaactgactacagcctccaatggaggggtcattgaggagttatcttgtgttagatccaataactatgtgcaggaaccagagtgcaggaggaatcttgttcagtgcctccttgagaagcaggggactcctgtggtacaagggtccttggagctagagagggtcatgagttccctcctggacatgggtttcagcaatgcccatattaatgaattgctcagtgtacggcgaggtgccagtcttcaacagttgctggacatcatttcagaatttattctcttgggtctgaatccagagcctgtgtgtgtggtcttgaagaaaagtccccagttattgaaactgcctattatgcaaatgaggaagcgctccagttacctgcaaaagcttgggcttggagaagggaaattaaagagggtgctttactgttgccctgaaattttcaccatgcgccagcaggacattaacgacactgtcaggcttctcaaggagaagtgccttttcacggtacagcaagtcaccaagattttgcacagttgcccctctgttcttcgagaggacctgggtcaactggaatacaagtttcagcagcctcgtcttacagcgtgactgcaaagaaaaagacttttgttttgcaaaagaaaagcagctcggtgactccgtccacatcgccacagttgagtcagatggcagtggcagtcctttgccagtggaaggagttcctgctaaggggaggtgcaggaggactaatttattattgtgcaactgccagtcctgcgcattccagctacgctaagcgccctgcccaggcacgtaacaaaacatagacctgttttgaagtggcttgttacccaagggtgcctcactcatctgcgccaccaggaagatgaactgtgagggctcctataaggggcaggaagagcaaagctgtcctaggccaaccagagattcatctttcatgcagtgacatgttgataaaaaatgatggtcagtatgaaactggtaacaggttgtagatggctttctatggtatatcccagtctcttgcaaacgattgtgaagaatgccagtgttgtttaagattcggcagtttgtgtggggaggtgggggcaggatggggtttggttgccaaaagagtttgggaaatgctggcttaaacaaaggcgagaggaagttcctttcacgtcaggatttatgaatgcctatgagcccagtgtcagtgacgactttctagcggcggtcttcaacactttctaaatattaagcgatcaaggcccctgccccacttttagttccaacagaatgccgttcacaagatctgggaggcactctctcagccctctcctggagcccccggaatttctcagcagcccaggccctcccgctgcccgtggcccctcctcccaggtgccaggtggtcttccagcctctccaagggcccacccccctgcctcttcctcccactgcagctgatctaggggtttcttggccacatttcccttgagagagagtgggatttgccctatccacagagagcctcatttccacctgaaggtgtatttgtcagtggctagaccaggttcatgtctgtttccccttggggacttctgaaccttcctgcccgggagtctgtaacacagcagcacaggaccgcgcttcctttagcagtgctgagtaagcaggcagcggcactctgagatcccggggctgggcagtcgccccccacttcccagcagctctgtggtagtggggcgggagcagcagggacgtaccttaagatttctccagtgtctgactcttactttgtttcctgaaataattagagaaaagtcgtttaatgaaaaagagactgtgtaccttgaattctacagctacctcagtccaggctgcctgctgagatcctgtctttagctcacatacattccacggtgggggacaccattagtccagacaccgctgtggagattagcattttagtttgtgtgcgcccgcctggcttgaggcagtagtttaggaatgacaaggctagaaacctggctggctgtgagtcagagagagagaggatggacgtgggagaaagcaagcaaaagctaccctagggaagagccggtgacgtgcacaggccgagcagcacggctggtgagctgcaggctgcggccttgcccggacacttggtaatgccaaacaagtacgtgtggctactcattggtctatgaggacgatgacaggcttcgactctgtggtttctaaagcatataatattctcacgtacttctttcagcaaacgccaaacagtagtaattcttgtaactaccttgaaccctttgtggaaagaacctgggtgtgagtgaataaaaagtaaagagcgacgcgctatatcggccattaaatactcggggctgtccgtaacaccctgtgcttcccaattgtagcaccatgttctgtgtgaatatgcataaccagagtgaccccccccagcacccagcatgcccggctgtgcccctctgggtatgctcacatgcacatatatggacatacagtttcgtagcagaacgtggctgcccaggggctgcctatctgggcgagtagaccgcctggctcagcccacaggcctgcagcatcccatagcaccccgcccttgccccatcaccctgtgggctacatgcaggacacggcatgggcctgctccccagaggcacctgtttggggtcttcttgaggcttgtgctttcacagctctctttgaagcagatgtcttggtgaactcggtagactcttttatacctgttgtcacaagaaagctttgtaaaaccagacagtgaagcaaaatgttgccaactgcttaacctaggctatgtgaacccacagtaaacctgaaggtgtttgagggaaaaactgctattttctgaatgaaacgtgacctcctattgatgtattaaaatgtctaacataaaggtcatgtgatttgtaataaatttattgtggtacagtaatatgcataaaataaacccattttaatgtg

SEQ ID NO: 349303 - DNA, 2535 bp, Homo sapiens
tgctgggtggctgctctcaggactcctctttgtcgccagggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 349304 - DNA, 2838 bp, Homo sapiens
gctccggcccgccccgctgcccggcccgcgcgccgggccatggcgcagctgcgggatgtgtcgctgcaggacccgcgggaccgcttcgagctgctgcagcgcgtgggggccgggacctatggcgacgtctacaaggtgcgacgggacgggcgggagagccgggaggagggtgccagccccgcaccccgcggcaggatctagcccccggccccgccccccatcccgcttcaccctccgcccctgcaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagagcgactgaaggggctccaccacctgcattctcaggggaagatccacagagacatcaagctgactttggggtgtcaggcgagctgacagcgtctgtggccaagaggaggtctttcattgggactccctactgggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 349305 - DNA, 2655 bp, Homo sapiens
tgctgggtggctgctctcaggactcctctttgtcgccagggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggtgccacacagagggaggctggagctgggatccaggccactgcagagggtacgattggagtgggatgtggttacagggcaacctggtaacggccgggctgggccctgcccctcctaccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 349306 - DNA, 2571 bp, Homo sapiens
tgctgggtggctgctctcaggactcctctttgtcgccagggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgttttagtcctctggtccctctgggtagggggagtgaaccca

SEQ ID NO: 349307 - DNA, 2344 bp, Homo sapiens
tgctgggtggctgctctcaggactcctctttgtcgccagggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctgggccatccattccattttgttccacatttcctttctactctttctgccaagagcctgcccctgcatttgtcctgggaaacacggtatttaagagagaactatattggtattaaagctggtttgtttta

SEQ ID NO: 349308 - DNA, 2412 bp, Homo sapiens
tgctgggtggctgctctcaggactcctctttgtcgccagggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgttttagtcctctggtccctctgggtagggggagtgaaccca

SEQ ID NO: 349309 - DNA, 690 bp, Homo sapiens
gacctgagcatccctgctgccccctagaacttctccagccctctgcccagcccagctgggatgctggagccgctgtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 349310 - DNA, 377 bp, Homo sapiens
ttcaccaggtgaaatttggcgccccacgcaggaaggaaactgacccactgaatgagccggtgagtgggcaggccttgaggggaaggtggtgcccagaggtggggcagggaggtcggatggaggccgagcagctcaaatcaagggagatttgaagctgggtggcctcgggccttgggccttggactgtccaagcaagcctgtcctacccagggacctggagggttaggggctccttcctgggccaagttcttttaggtgggtgtctggaaggtagcacagagaccatgcctttcccaaaaggaggccgtcatgtgcctgagccctcaccctaccctgctcagcctcgttttcccacctgtgtgtccccagtggtctga

SEQ ID NO: 349311 - DNA, 2902 bp, Homo sapiens
gctccggcccgccccgctgcccggcccgcgcgccgggccatggcgcagctgcgggatgtgtcgctgcaggacccgcgggaccgcttcgagctgctgcagcgcgtgggggccgggacctatggcgacgtctacaaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagagcgactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 349312 - DNA, 3013 bp, Homo sapiens
gctccggcccgccccgctgcccggcccgcgcgccgggccatggcgcagctgcgggatgtgtcgctgcaggacccgcgggaccgcttcgagctgctgcagcgcgtgggggccgggacctatggcgacgtctacaaggtgcgacgggacgggcgggagagccgggaggagggtgccagccccgcaccccgcggcaggatctagcccccggccccgccccccatcccgcttcaccctccgcccctgcaggcccgcgacacggtcacgtccgaactggccgccgtgaagatagtcaagctagacccaggggacgacatcagctccctccagcaggaaatcaccatcctgcgtgagtgccgccaccccaatgtggtggcctacattggcagctacctcaggaatgaccgcttgtggatctgcatggagttctgcggagggggctccctgcaggagatttaccatgccactgggcccctggaggagcggcagattgcctacgtctgccgagagcgactgaaggggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 349313 - DNA, 2623 bp, Homo sapiens
tgctgggtggctgctctcaggactcctctttgtcgccagggctccaccacctgcattctcaggggaagatccacagagacatcaagggagccaaccttctcctcactctccagggagatgtcaaactggctgactttggggtgtcaggcgagctgacagcgtctgtggccaagaggaggtctttcattgggactccctactggatggctcccgaggtggctgctgtggagcgcaaaggtggctacaatgagctatgtgacgtctgggccctgggcatcactgccattgagctgggcgagctgcagccccctctgttccacctgcaccccatgagggccctgatgctcatgtcgaagagcagcttccagccgcccaaactgagagataagactcgctggacccagaatttccaccactttctcaaactggccctgaccaagaatcctaagaagaggccgacagcagagaagctcctgcagcacccgttcacgactcagcagctccctcgggccctcctcacacagctgctggacaaagccagtgaccctcatctggggaccccctcccctgaggactgtgagctggagacctatgacatgtttccagacaccattcactcccgggggcagcacggcccagccgagaggaccccctcggagatccagtttcaccaggtgaaatttggcgccccacgcaggaaggaaactgacccactgaatgagccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggaaccctgcccccacctccttcaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtgggtaagaaatgggctgggcggggtggggcggggcctggtggggggcagcgcaggcccagcccggtgcccactgcctgctcccctgccagtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 349314 - DNA, 1821 bp, Homo sapiens
  misc_feature (22)..(22): n is a, c, g, or t
ccatggaggatggaaactgacncactgaatgaccgtgggaggaagagtggacactactgggaaaggaagagttgagtgggagcctgctgcagtcggtccaggaggccctggaggaaaggagtctgactattcggtcagcctcagaattccaggagctggactccccagacgataccatgggaaccatcaagcgggccccgttcctagggccactccccactgaccctccagcagaggagcctctgtccagtcccccaggccccaacagctccccactgctgcccacggcctgggccaccatgaagcagcgggaggatcctgagaggtcatcctgccacgggctccccccaactcccaaggtgcatatgggcgcctgcttctccaaggtcttcaatggctgccccctgcggatccacgctgctgtcacctggattcaccctgttactcgggaccagttcctggtggtaggggccgaggaaggcatctacacactcaacctgcatgaactgcatgaggatacgctggagaagctgatttcacatcgctgctcctggctctactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 349315 - DNA, 1318 bp, Homo sapiens
  misc_feature (22)..(22): n is a, c, g, or t
ccatggaggatggaaactgacncactgaatgaccgtgggaggaagagtggacactactgcgtgaacaacgtgctgctgtcactctcagggaaatccacgcacatctgggcccatgacctcccaggcctgtttgagcagcggaggctacagcaacaggttcccctctccatccccaccaaccgcctcacccagcgcatcatccccaggcgctttgctctgtccaccaagattcctgacaccaaaggctgcttgcagtgtcgtgtggtgcggaacccctacacgggtgccaccttcctgctggccgccctgcccaccagcctgctcctgctgcagtggtatgagccgctgcagaagtttctgctgctgaagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctgaggggatcccaggctcggcccagcaggtgatccaggtggacagggacacaatcctagtcagctttgaacgctgtgtgaggattgtcaacatgcagggcgagcccacggccacactggcacctgagctgacctttgatttccccatcgagactgtggtgtgcctgcaggacagtgtgctggccttctggagccatgggatgcaaggccgaagcctggataccaatgaggtgacccaggagatcacagatgaaacaaggatcttccgagtgcttggggcccacagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgtttta

SEQ ID NO: 349316 - DNA, 1138 bp, Homo sapiens
tttttttttttaactctgttgcccaggctggagtgcagtggcatgatctcggctcactgcaacctccacctcctgggttcaagtgattctgctcctcagcctcccgagtagctgggattttaggcatgcaccatcacacccgaccaatttttgtatttttaataaagacggggtttcatcttgttggtcaggctggtcttgaacccctagggacctcaagtgatccacccgcctcagcctccccaaagtgctgggattatgtcaccacaccagaccagttcgccattttcttagcccagcatgcttcactactctatgttatcttcctggccattgaaagcactggagtctgctttaaagaatctatgttgatcagaaatgttcccttagattgtaaattggtacagattctttggaaggcaatttggtagcaccaccagattttttcaatgtacgcatagtctttgacacaaaaattctaagaatttatatcttaggcatccacttgttcatgtatataaggatatttgtccaatgatattcactgaagccttgttcgtgatagaggaaaacagaataacttcagtgtctatcagtagggggctgactaataatgtgttacagccctagaatagaatactaattggtatgtataaagaatgaaatgtatcaatacatactgatatgtaaatgtttctaaggtgttagtgaaataaagtgtatagaagaatgactaatgtgaaatagaatatatatgggattacatgcaacaaaaatttctgaggaggtgaataagagactattgctatatctgggaatgagttgtatagtgggatggacttctcccactttgtaacttttttttccctgtttctccaaatcatatgcctatgttattttctgtatgatacatttacatatatatgtgtgtgtgtatgtatatacacatacatatatataaacatccactatctttaatccagaaaagaagtatcattaataggttttttgaatctataaagtgccataaacagtattttatgtagtgataaacagtattttcataatcacaaaacttataattttgtttagtgtgtttaatttaaaacaagtttaattgaactctttgtaaacagtt

SEQ ID NO: 349317 - DNA, 1600 bp, Homo sapiens
acagtatcacttctttgcacccatgaatgtgatctatttaggtctttaacatcctttggtaccttacattctctgtagggttctggtaccatttttaaagaattattctttgatgtgtcttatggggtattttaaaatttcattttctaacttgtatatgaactaacttgtatatgaagtttcttttttgggggaaattttgaatgtagcaattttttaaaaaatgaagttacataaacatgttaccaaaaatagaaaacagcaaaaaggaaatcaaaatccatagacttaccaccccccccacaatgtagcctaagtagtattttaatttttgagacagggtctcactctgtcccccaggttggagtgcagtggggcaatctcagctcactgcaacttctacctcctggcctcaaacaatccacctgccttagcctcccgaagtgctgggattacaagtgtgggctaccacccccagccagtttttgttttgttctttagtacatgtctagtttttttcttttgtcattttacaaccataacttttaaaattatactggaggcgagggagatgcatcttcctagccatggcactcctggggaaaggctgacttggcttatggctgtcagtgcacagcagcgccagtatgcagaatgcctgtgcctctgctggagcagctcagtgaggcggacaccaggtcactttaactagttttggtgccaaactagttttgtgagatagctgcagaagtgctcgtttctgtctgttgccacttcacttttggagacagggtcttgctctgtcacctaggctggagtgtaccagtggcgccatcagagctcactgcagccttggcctcccaaagtggtgggattacaggcgagagccactgtgcccagccagcttcactttcatttgttttaaaatttggtgttctgtccacatagttcagaattcaaaactgcttacaggggaaaatttcctcctacctgtgtccccagtgcagccagcattagggcttttgtatttctgcagagattatgtgcatttgtgggcagctgcgcccgtgggcttccaagggggaacttgctgtgcagtgggtccttgccttgcttttctcccttagggtaactaggtgacctccacattagcatattaagaatgtcctttttttccagctacgtagactagaaatgtgaggatgtgcatttgaagtgtttcctctgttaggttgggtgcggtgcctcacgcctgtaatcccaacattttgggaggcctaggcgggtggatcacttgaggtcaggagttcgagacctcatctctactaaaaatacaaaaactagctgggggtggtggtgggtgcctgtaatcccagttacttgggaggctgaggcaagagaacctcttgaaaccaggaggctgcggtgagccaagatcatgccatttcactctagcttgggtgaaggagtgagagtctatctatctatctatctatctatctatctaaaaaaaaaagtgtttaaagggatgcagttaggaaatggaatggctgagtctcagcatatcatccacatgtggttttcccgactccagttgtcc

SEQ ID NO: 349318 - DNA, 499 bp, Homo sapiens
aaaaggtgccccatgcccctcataatgggtttctcctcttgcctttcaatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgattaacccgagtgtgtgttgggctttttttctgggtcctgtggcaggatgggtcctctcttcctgcagttcaactggtgtggggaggggctgctcacttcagcatcacctccactggatagtggtcactgatggcttgggcctgcaggcaagtgggcacagggtctgggctgagcctacctgagctcctgtgtcccatcctcatgtggctgtgcaagggaggacacataccagttggtcactcaggccataggcagcc

SEQ ID NO: 349319 - DNA, 590 bp, Homo sapiens
attttttccataaacattttttgtccattttttattgagatacaacttacatagcatcagattcacagaattcaccttttaacacgtaaaattcagtggcatttagtgcattcacagtgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagttaacagcacacaggtaagagtcagagacatttctaggtctttgtaggtgtgcacgtgtgacatgtcttatcaatgcagacccaccatgtgtgcaggggtctgtccagtgctcctgccacggtg

SEQ ID NO: 349320 - DNA, 659 bp, Homo sapiens
tttttttttgagatggagtcttgctctgtcacccaggctggagtgcagtggcgcgatcttggctcactgcaagctccgcctcccgggttcaggccattctcctgcctcagcctcccgagtagctgggactttaggcgcccaccaccatgcctggctaattttttgtatttttagtagagacggggtttcaccctgttagccaggatggtctcgatctcctgacctcgtgatccgcccacttcggcctcccaaagtgctgggattacaagcgtgagccactgtgcccagccagagttgtgatttttaacataaagcccaggctgtcattttccgagtgttaccccgaggctgtcccggccacccacagcccaggtcactgttctgggaggtggcaggacgtagaggaagctccggcagtgccgcctccctgcttccctcttagcacacgtgctgggttgaaggccaggcctgaagacaaagggcaggttaatggggaatgttgggtggtgtggagggccgcagccccgggagaagctgactgccgtgtctcccaggtgtggtggacagtgaggacattcccctgaacctcagccgggagctgctgcaggagagcgcactcatcaggtgagcctcgggccgcggggagaggaccctgctgg

SEQ ID NO: 349321 - DNA, 210 bp, Homo sapiens
ctgtgcttctttaaatatcctgataatcccaaaacatgaagggagggtcacagcacgtggtactgagctgcttttctggtgggttctgtgttgaggcacgcgctcatcaagaagctgaatcagctgcgcgcaagcgagcctggcctggctcagctgctggtggatcaggtgagtgcagcagcttaggatgactgcagggacccaggctac

SEQ ID NO: 349322 - DNA, 2402 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349323 - DNA, 2523 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgattaacccgagtgtgtgttgggctttttttctgggtcctgtggcaggatgggtcctctcttcctgcagttcaactggtgtggggaggggctgctcacttcagcatcacctccactggatagtggtcactgatggcttgggcctgcaggcaagtgggcacagggtctgggctgagcctacctgagctcctgtgtcccatcctcatgtggctgtgcaagggaggacacataccagttggtcactcaggccataggcagcc

SEQ ID NO: 349324 - DNA, 2348 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349325 - DNA, 2281 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349326 - DNA, 2034 bp, Homo sapiens
  misc_feature (2013)..(2014): n is a, c, g, or t
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgcacatcnnatcgggccgagctcgatcgt

SEQ ID NO: 349327 - DNA, 2316 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349328 - DNA, 1996 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaagacgtcattgacatgagagcggacagtccgaagggacaaccaccgcagcacgactacagaggagcagactcacaggctcgactccgccagagcaggacacacgcaccgagccggcgaggccaccaggcagggaggagcaccaga

SEQ ID NO: 349329 - DNA, 2622 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaaca

SEQ ID NO: 349330 - DNA, 2494 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaaca

SEQ ID NO: 349331 - DNA, 2309 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggtgggtgagcggtgggtggggcgggctccgggggctgcaacctggggagggtcttgaccttctcagctctgtgctgggtgaacctgcccaagactccgggcagggctgcacagtgggtcagggtcacgggcacagaggccggaccgactgtgacggctgtttcccacttggaggtcacatgtggttttttttgtttgttttttgtttttttgagatggagtcttgctctctcgcccaggctagagtgcagtggtgcgatctcggctcactgcaacttccgcctcctgggttcaggtcattctcctgcctcagcctcctgagtagctgggactacaggtgcacaccaccacacccagcaaatttttgtatttttaatagagacggcatttcaccatgttggtctcgaataaaaatacaaaaactagctgggggtggtggtgggtgcctgtaatcccagttacttgggaggctgaggcaagagaacctcttgaaaccaggaggctgcggtgagccaagatcatgccatttcactctagcttgggtgaaggagtgagagtctatctatctatctatctatctatctatctaaaaaaaaaagtgtttaaagggatgcagttaggaaatggaatggctgagtctcagcatatcatccacatgtggttttcccgactccagttgtcc

SEQ ID NO: 349332 - DNA, 2056 bp, Homo sapiens
acgggcgacgaaaacttaggcaggtacgaggcctgggtgttgggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349333 - DNA, 2349 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349334 - DNA, 2081 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagagtattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349335 - DNA, 1493 bp, Homo sapiens
gtgaacacgacgccctccccgccgatctccgtttccaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349336 - DNA, 1358 bp, Homo sapiens
  misc_feature (30)..(31): n is a, c, g, or t
  misc_feature (33)..(33): n is a, c, g, or t
  misc_feature (35)..(35): n is a, c, g, or t
ggacgcgtgggtcgacccacgcgtccggannangngtcggcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349337 - DNA, 1978 bp, Homo sapiens
attttttccataaacattttttgtccattttttattgagatacaacttacatagcatcagattcacagaattcaccttttaacacgtaaaattcagtggcatttagtgcattcacagtgtggtgtggctgcctccactgtaaccccagaacatttcatcccaggagcccatcccgtgctggtgtcccttctccccagcagcaggaggagggtgaccacgtgtgtggggtcccaaggaggccgtgttctggttgtttgccgacttcggcagcttctgacacaggcctcttcattctcctttatcttcatttgagttaacagcacacaggtaagagtcagagacatttctaggtctttgtaggtgtgcacgtgtgacatgtcttatcaatgcagacccaccatgtgtgcaggggtggcctgggccctgctggttgggtgtccagctccttgcttttccctctttctgttttccccctgcgtccttccagctgcagctcccatgagctctagaggtcacagctgcgttcagctgatggggaggagggcaaacccctcccctaagggcccttctccaaatcccactgaaacccactgggcaaagccagtctctgccatagccagctgtgaggagggccgggaaccgtggacttcacccgtgtccgtgtgcccaccagagactgactctgtcactgagggcagagggaagacgctgggtccaggccgggctctgctgttgggtggggtcccctcccagggcgtggtgcgcgtagctccctggagagcccctgggccacctggggcaggaggtgcttcctaagcccccagagctcccaaaaggggcctgatgggcagagcaaggcctgctctcggacaacccccgagtccactaccgtccctcgggtcagggccagcctggagtgccaggaggccatgggcatcggagggtttgcgcccagttagttgggcaacattgagcccatgggcctggaataagtggtgacctgccccgtcccttctaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349338 - DNA, 839 bp, Homo sapiens
  misc_feature (768)..(768): n is a, c, g, or t
  misc_feature (778)..(778): n is a, c, g, or t
  misc_feature (788)..(788): n is a, c, g, or t
  misc_feature (818)..(818): n is a, c, g, or t
  misc_feature (825)..(825): n is a, c, g, or t
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctnggaatttttnaaattccccnaaactttccgggattttaaaacccgggaancaaaatntcctccccccccct

SEQ ID NO: 349339 - DNA, 1152 bp, Homo sapiens
attttttccataaacattttttgtccattttttattgagatacaacttacatagcatcagattcacagaattcaccttttaacacgtaaaattcagtggcatttagtgcattcacagtgtggtgtggctgcctccacttgcactcagccacatgtggatttctttatgcgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349340 - DNA, 1101 bp, Homo sapiens
attttttccataaacattttttgtccattttttattgagatacaacttacatagcatcagattcacagaattcaccttttaacacgtaaaattcagtggcatttagtgcattcacagtgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349341 - DNA, 2182 bp, Homo sapiens
ttttttttttgaggcggaatcttgctctgctgcccagcctggacgtgcagtaatactatctcggctcactgcaacctctgcttcctgggttcaagcaattcttctgcctcagcctcccgagtagctgggattacaggcacgcaccaccacacccggctaatttttgtatttttagtagagacagggtttcaccatgttggtcacactggtctcaaactcgtgaccttgtgatccgcctgcctcggcctcccaaagtgctgggattacaggcgtgagccatcgcacccagcctattttttaagtttctcacagacacaaggtctccaagtcctgagcccaagcaatcttcccgcaaatgctgggattacaagtgtgagccaccgcaccccgccactcatttcttggaatctttgactttccattcgtattcatttcctgagactggtgaaactaccacaagtttggttgcttaaaataacagaaatggatcctctcaaaattccggagactggacgtctgaagtcagggagtcagtaggaccttgcgcctcctggaggctccgggcggttgggggatgctccttgccctccagtttctgcaggctgccagcaatccttggctttccttagttgtggctgcatcaccccagtctctgcctcttcttcttaagatctgtgcacctgcatttggggtcctcccagagagcagggaggatgtccttatctcaacagcctttactcacatctgcaagtccttttttgctacaaaaatcaacattcagaggttccagggctagggcacagctatcttttgagccacccctgggtcttgcccacttggaaggggctgtgctggccctccaaggacagccctgcacgtagcatctgtggtccccctgggggaggagggcctggaaggcttggcagaagtccaggcgggattcaggtatgagaactgcaggaaatgaatacaaatggggtctgcaggaggcctcaacggcaagagtcagcaggggccaaggtcgaaagtcaggaaagtgctcggtctggccagctggccatgaagcagaaggcaggcccagtggggactagaaacaggaaggtaaaccaccctccacaagactggcaccccattccataaagacacgccaacagacgcctctggctggcagcactggtgcactcatctgtccctcctattgagacggcgtctaccagatggaaacaccaccactcctcaggctgccagaggccccattgcaggcttttccaaaggtttcagcaatggttcttccctgtttttaatctctaagtctaggacagcctccagcacgtcaaaacccagcccccaagcaaggccaccggagtattcggtgtagggactagtcctctgcctttggtgtttgcctttcctggacacacatctgacagcgacccatcacggggaagggagtaaagctagagggcggccactgtcctccaccaagaaactgcctggtgcagcttccggcggggcacagggacaccaattatagctcacagagcaagtgcccaaccccctacgtgtgctcagcacgtgggacgagggttcccctctggtctgtcatcccctcctggctcttgaccaaatgctgccccatctgctttcaggaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaaca

SEQ ID NO: 349342 - DNA, 1947 bp, Homo sapiens
ttttttttttgaggcggaatcttgctctgctgcccagcctggacgtgcagtaatactatctcggctcactgcaacctctgcttcctgggttcaagcaattcttctgcctcagcctcccgagtagctgggattacagtgtgagccaccgcaccccgccactcatttcttggaatctttgactttccattcgtattcatttcctgagactggtgaaactaccacaagtttggttgcttaaaataacagaaatggatcctctcaaaattccggagactggacgtctgaagtcagggagtcagtaggaccttgcgcctcctggaggctccgggcggttgggggatgctccttgccctccagtttctgcaggctgccagcaatccttggctttccttagttgtggctgcatcaccccagtctctgcctcttcttcttaagatctgtgcacctgcatttggggtcctcccagagagcagggaggatgtccttatctcaacagcctttactcacatctgcaagtccttttttgctacaaaaatcaacattcagaggttccagggctagggcacagctatcttttgagccacccctgggtcttgcccacttggaaggggctgtgctggccctccaaggacagccctgcacgtagcatctgtggtccccctgggggaggagggcctggaaggcttggcagaagtccaggcgggattcaggtatgagaactgcaggaaatgaatacaaatggggtctgcaggaggcctcaacggcaagagtcagcaggggccaaggtcgaaagtcaggaaagtgctcggtctggccagctggccatgaagcagaaggcaggcccagtggggactagaaacaggaaggtaaaccaccctccacaagactggcaccccattccataaagacacgccaacagacgcctctggctggcagcactggtgcactcatctgtccctcctattgagacggcgtctaccagatggaaacaccaccactcctcaggctgccagaggccccattgcaggcttttccaaaggtttcagcaatggttcttccctgtttttaatctctaagtctaggacagcctccagcacgtcaaaacccagcccccaagcaaggccaccggagtattcggtgtagggactagtcctctgcctttggtgtttgcctttcctggacacacatctgacagcgacccatcacggggaagggagtaaagctagagggcggccactgtcctccaccaagaaactgcctggtgcagcttccggcggggcacagggacaccaattatagctcacagagcaagtgcccaaccccctacgtgtgctcagcacgtgggacgagggttcccctctggtctgtcatcccctcctggctcttgaccaaatgctgccccatctgctttcaggaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaaca

SEQ ID NO: 349343 - DNA, 2799 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaaca

SEQ ID NO: 349344 - DNA, 3113 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggtgggtgagcggtgggtggggcgggctccgggggctgcaacctggggagggtcttgaccttctcagctctgtgctgggtgaacctgcccaagactccgggcagggctgcacagtgggtcagggtcacgggcacagaggccggaccgactgtgacggctgtttcccacttggaggtcacatgtggttttttttgtttgttttttgtttttttgagatggagtcttgctctctcgcccaggctagagtgcagtggtgcgatctcggctcactgcaacttccgcctcctgggttcaggtcattctcctgcctcagcctcctgagtagctgggactacaggtgcacaccaccacacccagcaaatttttgtatttttaatagagacggcatttcaccatgttggtctcgaactcctgacctcatgatctgcctgctttggcctcccaaagtgctgggattacaggcgtgagccactgcactcagccacatgtggatttctttatgcgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349345 - DNA, 2684 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggtgaggccacgctcctggctcttccagcctgtgggattccccagaatcctgtgtgtggtgttcttttgttgtggaatgtgacacagaagaaaagtgcgtgaggcctgtggacatgtgggtaactataaggagctgtatgcagtttaggctgcacccatgtgaaatggaacctggccagccccttaccatccccaggtgtcacctgggaggttagccacatcccagcctgtgaccatgtcctcgttttgctttatggctttgccacctgtgcgtgtcctggacatgctcagttttgcctgttttgagctttgtacgtggatcttggtgtttgctgaagtctcacgttgctcacttggcatgagggttgcccatgcagaggggctgccacaagttcattttcatagccgaataatgtccgctgcagaaacccacctcggcacagcagactgctccgttctgctctgctgggcctccggtggttcttggtcagaagttgtggagagccaggctgctctgagtattcttgtccacgtgtctggggcttgtgtgggtttctctgtggccccggtggtgggagctgcttccagggtgcaccgagaaccccccagccctgacagtggctgagccgtaagatttccctcgtttcttcctgttgttctttatatgccctttatctgttgtaaat

SEQ ID NO: 349346 - DNA, 2671 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaaca

SEQ ID NO: 349347 - DNA, 4005 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggtgggtgagcggtgggtggggcgggctccgggggctgcaacctggggagggtcttgaccttctcagctctgtgctgggtgaacctgcccaagactccgggcagggctgcacagtgggtcagggtcacgggcacagaggccggaccgactgtgacggctgtttcccacttggaggtcacatgtggttttttttgtttgttttttgtttttttgagatggagtcttgctctctcgcccagcgtgcagtaatactatctcggctcactgcaacctctgcttcctgggttcaagcaattcttctgcctcagcctcccgagtagctgggattacaggcacgcaccaccacacccggctaatttttgtatttttagtagagacagggtttcaccatgttggtcacactggtctcaaactcgtgaccttgtgatccgcctgcctcggcctcccaaagtgctgggattacaggcgtgagccatcgcacccagcctattttttaagtttctcacagacacaaggtctccaagtcctgagcccaagcaatcttcccgcaaatgctgggattacaagtgtgagccaccgcaccccgccactcatttcttggaatctttgactttccattcgtattcatttcctgagactggtgaaactaccacaagtttggttgcttaaaataacagaaatggatcctctcaaaattccggagactggacgtctgaagtcagggagtcagtaggaccttgcgcctcctggaggctccgggcggttgggggatgctccttgccctccagtttctgcaggctgccagcaatccttggctttccttagttgtggctgcatcaccccagtctctgcctcttcttcttaagatctgtgcacctgcatttggggtcctcccagagagcagggaggatgtccttatctcaacagcctttactcacatctgcaagtccttttttgctacaaaaatcaacattcagaggttccagggctagggcacagctatcttttgagccacccctgggtcttgcccacttggaaggggctgtgctggccctccaaggacagccctgcacgtagcatctgtggtccccctgggggaggagggcctggaaggcttggcagaagtccaggcgggattcaggtatgagaactgcaggaaatgaatacaaatggggtctgcaggaggcctcaacggcaagagtcagcaggggccaaggtcgaaagtcaggaaagtgctcggtctggccagctggccatgaagcagaaggcaggcccagtggggactagaaacaggaaggtaaaccaccctccacaagactggcaccccattccataaagacacgccaacagacgcctctggctggcagcactggtgcactcatctgtccctcctattgagacggcgtctaccagatggaaacaccaccactcctcaggctgccagaggccccattgcaggcttttccaaaggtttcagcaatggttcttccctgtttttaatctctaagtctaggacagcctccagcacgtcaaaacccagcccccaagcaaggccaccggagtattcggtgtagggactagtcctctgcctttggtgtttgcctttcctggacacacatctgacagcgacccatcacggggaagggagtaaagctagagggcggccactgtcctccaccaagaaactgcctggtgcagcttccggcggggcacagggacaccaattatagctcacagagcaagtgcccaaccccctacgtgtgctcagcacgtgggacgagggttcccctctggtctgtcatcccctcctggctcttgaccaaatgctgccccatctgctttcaggaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaaca

SEQ ID NO: 349348 - DNA, 3333 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggtgggtgagcggtgggtggggcgggctccgggggctgcaacctggggagggtcttgaccttctcagctctgtgctgggtgaacctgcccaagactccgggcagggctgcacagtgggtcagggtcacgggcacagaggccggaccgactgtgacggctgtttcccacttggaggtcacatgtggttttttttgtttgttttttgtttttttgagatggagtcttgctctctcgcccaggctagagtgcagtggtgcgatctcggctcactgcaacttccgcctcctgggttcaggtcattctcctgcctcagcctcctgagtagctgggactacaggtgcacaccaccacacccagcaaatttttgtatttttaatagagacggcatttcaccatgttggtctcgaactcctgacctcatgatctgcctgctttggcctcccaaagtgctgggattacaggcgtgagccactgcactcagccacatgtggatttctttatgcgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaaca

SEQ ID NO: 349349 - DNA, 2098 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccaggactgacaccacagatgacagccccacctccttgagctttatttacctaaatttaaaggtatttcttaacccgattaacccgagtgtgtgttgggctttttttctgggtcctgtggcaggatgggtcctctcttcctgcagttcaactggtgtggggaggggctgctcacttcagcatcacctccactggatagtggtcactgatggcttgggcctgcaggcaagtgggcacagggtctgggctgagcctacctgagctcctgtgtcccatcctcatgtggctgtgcaagggaggacacataccagttggtcactcaggccataggcagcc

SEQ ID NO: 349350 - DNA, 2153 bp, Homo sapiens
ctacgctagaacaggcatggattaaatcggacgagggcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349351 - DNA, 2049 bp, Homo sapiens
  misc_feature (30)..(31): n is a, c, g, or t
  misc_feature (33)..(33): n is a, c, g, or t
  misc_feature (35)..(35): n is a, c, g, or t
ggacgcgtgggtcgacccacgcgtccggannangnggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349352 - DNA, 1830 bp, Homo sapiens
cgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagaactcccaggcatagtgcccctgcttcctctacctgccagaaggaaggctggaacttgggcctcgcttgtacaaatggcgagtgctgcctgctgtgtggctgccctcaggacgggctttggtgagggcagcacagccctggaggagcctggtctgacatggggcccgtctgggatcactgttgggccttcaaccgtctggagcctctatgtcttcctctgatagattcccagaacaatcatttcaccttctaagaagccatcctgcccctgcagcctgtggcttgtggagtctccagcactctcacttctccctcgtggatctcttttctgtctgtgtcagtcaatgctgccatgtaacagccacctgcaaactcagtgtatacacatgcatttctctcacactgccaggtctgctggggtggctctgctgcctgggcctcgtcctggggctgggctggagagactgcagctccctgggcaccctcttcccacagtgtggaaggtggaggctcccagggcacaagcagaaca

SEQ ID NO: 349353 - DNA, 1710 bp, Homo sapiens
cgctggagtcccatgcagggtatgtcccagtgtcacatccacctggcttttcctttctttgcctgccttagttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349354 - DNA, 1947 bp, Homo sapiens
gattattgaaatacattgtaatttacctgcttaaaggaaagactaaatattaagaagaaaataaaaatatccctagtcccagtgataaagttgttcctaattttaggccattatgtaatgctgcagtaaatatcctgatccctaaaatcccaattttgaaaaattagagtatacatatattcagtataaatcccaaattacagtgtacatatatagtatatacagtgctgctcctaatgatggaaaattgttatgtacatgtagaatgtgcattctttgcctgtatctatagacgtactgtaatttacccacattgggatttttctgggttttctttcaacacagctaactttctcatgtcattgaggattattaaaagatgcagttttttttttttatggccatttagcattacataattttagcctatattcttgaacatgaggttgttcataattgttatattttatgtgccacagtgaaaatcctggtacataaatcttggtgtgctcacatgtttcctaaggtgcagttcctataattggaacaactggctcaaaggttggaagggttttccgggcgtgggtatcttgtctctgggggcatcggttctcctactgcctccagggggtgtctgccctccaccctgctgcctcctgtccggccactgcccagggtttctgtctttctgctcagtctttttcagtttggccaataacggtaccttgttgttttcacttctttgattcttagcggggctgaacattttttcgtaccctctggccatttgtatttcatagaggctgcttgtatgtattaaatgcatttcttttctgtaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349355 - DNA, 1605 bp, Homo sapiens
cagtatcacttctttgcacccatgaatgtgagctatttaggtctttaacatcctttggtaccttacattctctgtagggttctggtaccatttttaaagaattattctttgatgtgtcttatggggtattttaaaatttcattttctaacttgtatatgaactaacttgtatatgaagtttcttttttgggggaaattttgaatgtagcaattttttaaaaaatgaagttacataaacaagttaccaaaaatagaaaacagcaaaaaggaaatcaaaatccatagacttaccacccccccacaatgtagcctaagtagtattttaatttttgagatggagtcttgctctctcgcccaggctagagtgcagtggtgcgatctcggctcactgcaacttccgcctcctgggttcaggtcattctcctgcctcagcctcctgagtagctgggactacaggtgcacaccaccacacccagcaaatttttgtatttttaatagagacggcatttcaccatgttggtctcgaactcctgacctcatgatctgcctgctttggcctcccaaagtgctgggattacaggcgtgagccactgcactcagccacatgtggatttctttatgcgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349356 - DNA, 851 bp, Homo sapiens
tcgtcatagctgactctagaggatacaccttatgctctgacccaccctatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349357 - DNA, 1018 bp, Homo sapiens
gaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgtcacaagctacaaggatattgagtcgttgatgtctgagggtaacaaatctcgcacagttgctgcaaccaacatgaacgaggagagtagccgatcccatgcagttttcaaaatcaccctcacacatactctctacgatgtgaaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaacaaaaaaaaaggggggcgcaaaattcctgggggccaggttaagggtccagcttctggtcaaagggcccaaggggcgaaaaagcagaccggcgggtaaaaggcgggggaaagctggattggagactactctgggga

SEQ ID NO: 349358 - DNA, 342 bp, Homo sapiens
aataatagcccatttagaattgtccccataatatatgcaaaggaggaattttatacttttttaatgtgtgtttctcatgtgtgtatgtatatgcacacaaaatctagatacttcttttagcagaaattctccttagttggttgatgtgaaataaaggatattttcctaaatcacatttataactgaaggtttggaaaacgttgtctgtatatgtttgtattttttcagtgattagacactgatataaatgctataggggtagggggaagaaaggataggagatttattttttatttgtttgactgtgtggattaatgctgctgtaaatttatattcactaac

SEQ ID NO: 349359 - DNA, 595 bp, Homo sapiens
agacctcctcattataacctgaatggggggacaaccagtaagctacccttttaccatctttggacaagtagcatccgtactatacttcacaaaaatcctaatcctaataccaactatctccctaattgaaaacaaaattctcaaatgggcctaaaaaaaaaaaaaaaaaaaaaaaaaaaacaataaaaaaaaaaaactcgctcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaatttaaaccccgagttgttgaccgccttaatctcgtgtccatagagcaaaacgtctgctcagatggatgcgaggcacagcgtccgcccacgctgctgtttttaatccatctcagtagagttgaacccattcgtggtattacagccatttctcggggaatgtgtttgtttataactcactaatgcttaca

SEQ ID NO: 349360 - DNA, 344 bp, Homo sapiens
tgcctgccagctgtgtgagatgaaaaagcttgccagccatcttctcagatgccctcacagtacaaagaaggaagatatttttttgtctgttttccacagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccgtgagtagccacaaactgcggcagctccgtcctctcttcttcatccttcaggttctccaaacacc

SEQ ID NO: 349361 - DNA, 6263 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 349362 - DNA, 6814 bp, Homo sapiens
  misc_feature (1383)..(1383): n is a, c, g, or t
  misc_feature (1776)..(1776): n is a, c, g, or t
  misc_feature (6273)..(6273): n is a, c, g, or t
  misc_feature (6281)..(6281): n is a, c, g, or t
  misc_feature (6283)..(6283): n is a, c, g, or t
  misc_feature (6288)..(6288): n is a, c, g, or t
  misc_feature (6305)..(6305): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaaaaaaaaaaanaaaaaaananaaaanaaaaaaaaaaaaaaaanaaaaaaaaaaaaaaagaaaaaaaaaaaaaaaaaaaaaaaaataaaaaaaaaaaaaaaaaaaaaaaaaaaaacattttggcccccttggcccaagccatttttaaactggacaagttttatcctggggcccaaattcggggctaattggccaaattccccttaagggggggggtttaaaattaaagggcccggtttttaaaaaggttgaacctgggaaaaccctgggggtccccaacttaaaccctttggaagaaaatccctttttgccaagtggggtaaaaaccaaaaggccctacccgaatggcctttcaaaaaatttgccacccctaaagggcaatggaaatttgaagggtaaaatttttgttaaaaatccgggtaaatttttggaaaaccacttattttttaccaaagggcccaaatcggaaaaccccttataaataaaagaattcccgcaaagggtttagggttgtccaatttgaaacaggtcccttttacgggcccccgtgggg

SEQ ID NO: 349363 - DNA, 1573 bp, Homo sapiens
gggaaacctgcttagctgcagcattcgttgtggccaggagataaaggctatcttagtctccagaagcaataaagctacatggaagggagaagggccaggactccttctggggtggctccttggggtcaaagagcgaccccttggaggccatcagagttttcttggggccagtgctgttaagaccccactaagggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 349364 - DNA, 1160 bp, Homo sapiens
gatgtatctagaggatcccacagccgatgggttcggattttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 349365 - DNA, 977 bp, Homo sapiens
gcactcggggtccctggagggcaagccctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 349366 - DNA, 6233 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 349367 - DNA, 3679 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgcagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 349368 - DNA, 4479 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactgccccacgttgtccctgagatttaacccctccactgctgggggtgagctgtactcttctgactgccccctcctgtgtaacgactacaaaataaaacttggttctgaatatttttaaa

SEQ ID NO: 349369 - DNA, 629 bp, Homo sapiens
gattatgctggtaaagccatgctccatctcctgtgtaattttaagaatgcctcaggatcttgatcccacttgtttaaaatttctattcttttctgcagctgagctgggaacaacagttttggaacccatcaagtaggaagtttgcacaactataatgtttcagtaagaattgtgtaggctgaaccagttgatatatctattcagttagggaacaaacaagattaatgtttcctcaaaaattgatgtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 349370 - DNA, 2845 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagagaatctgtacaggtggtatgaagaaaagatgggccctggccatgcttagtcagaggtgaagaaggaaaatagaaataatctggaatgcaattctattggtgtaaaaattaatacattttttaaaatgtcttaa

SEQ ID NO: 349371 - DNA, 2488 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccggcggccgaaggaatcccggcggccgaaggaatcccggcggccgaaggaatcccggcggccgaaggaatcccgcggccga

SEQ ID NO: 349372 - DNA, 603 bp, Homo sapiens
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgttcctcaagagaacctggtgcctctgcgctgcccacgtcgtctgggaggaccaaaggccaggacacgtctccctacccagggttctccggcaacactgcctcggcgggcaggccttccctctgcaaggaacccacg

SEQ ID NO: 349373 - DNA, 213 bp, Homo sapiens
tggcaaaggagatgatggctggccgggagctccgggcttaccaggtaaggtcacgtaaaacacgtggtcacccagacccagagtcgtgggctgtgcaggaggcaccgctgagcaggccagcctctctcagggcgacttctaaggcccatacgagagcaaaggcaggtctgctgtggcttacggtggtctgcaccaacatagcagcacagggta

SEQ ID NO: 349374 - DNA, 261 bp, Homo sapiens
cctgatggaaagcgagggcctccaggaccccccgggctccctggaccacctggacctgatggtgagtggagggaaacaaaagggagggtgtagcctaatgttcagatgaagcccggtcccagccggatgttatttgggattctctgctaaatgactctgggaacgaatccagtaggccagtgattagggtgcagtggatccaggtagattagggtgtagtgggtgctctctggggtccacgcaggagctggggatggaagc

SEQ ID NO: 349375 - DNA, 511 bp, Homo sapiens
gcggccgcatcatctcccagcccaccctcgccaggcggctcggctatcactacccaaaatgtaatagtctgaactacagaaagcacagtctcctggcattcgacaaggatttcaaaatgagatgagcccctgcctgtcttgttctctttgggcacctgtggctggtggctgggatgccaggctctgccaccctagcatggggatgctgccccaggcactgtctgtggttccactggttgaaatagctgctctgccagcctgacggtccacgctcgggtttcttctttggaaatatgtgtactgtcaaaaactccaaaaggctattctcacatcctgtttttctcttttctttctctagggagaagccggagacccagggccccctggactacctgcctactcccctcacccttccctagcaaaaggtgtgtgaacaatttcacctgcatagttcagcatcgcatacacattctctcctgttagggacacagagctatgaactttcaagaca

SEQ ID NO: 349376 - DNA, 200 bp, Homo sapiens
tgacccctccttccacagggctggcgggctcctgcctggcgcggttcagcaccatgcccttcctgtactgcaaccctggtgatgtctgctactatgccagccggaacgacaagtcctactggctctctaccactgcgcgcgaggctttgcccatgaagaacgttgtgtaaaagaacggaccatgccatacgtccacgcct

SEQ ID NO: 349377 - DNA, 1930 bp, Homo sapiens
gagacccggaagatctttagctcccgggacgccttgatcgccttgatcacctttaattccctgaagcccaggagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 349378 - DNA, 6596 bp, Homo sapiens
  misc_feature (1383)..(1383): n is a, c, g, or t
  misc_feature (1776)..(1776): n is a, c, g, or t
  misc_feature (6268)..(6268): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaaacaanacaaacacaaggggggcgccaaaaaaaacccccgcggggccacggaatagcgatcacagcttcgtgtacgaggggcccataaggagagggataaaaagcaagcgagggcgccgtaaacaccatggcggtgaacagcgcactggcaatgggaagaacacctgtggggggcaagtgaacccccagaataacgcaggcaaacaaaaggcgcgggagacaccacagctgagcggtgccggtaaaacagcacacagaaagaaagagagacagacacagagcaaagacaagatacagaaaaagagaagacaaagcggcagtagaccacaaccaa

SEQ ID NO: 349379 - DNA, 6530 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaagttagtcgttacacaggaggaagcagcactaggacatagatattcattccgtcataacaggcaatcttaggcactctatactacaagagatggtttcaattgtacctgttcttaccaaggactaatcaaaatgagttcggaggcgagccagttcaaatttctccctctgtaataaaagttccccaaaaaaagggggcccagggcgtcacagaaaacacaaacaacacaacaccacacaaaaaaaaaacaccctctcctgcgggagag

SEQ ID NO: 349380 - DNA, 6451 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaatttaaaccccgagttgttgaccgccttaatctcgtgtccatagagcaaaacgtctgctcagatggatgcgaggcacagcgtccgcccacgctgctgtttttaatccatctcagtagagttgaacccattcgtggtattacagccatttctcggggaatgtgtttgtttataactcactaatgcttaca

SEQ ID NO: 349381 - DNA, 6761 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaaaaaagaaaaaaaaaaaaaaaaaaaaaaaaataaaaaaaaaaaaaaaaaaaaaaaaaaaaacattttggcccccttggcccaagccatttttaaactggacaagttttatcctggggcccaaattcggggctaattggccaaattccccttaagggggggggtttaaaattaaagggcccggtttttaaaaaggttgaacctgggaaaaccctgggggtccccaacttaaaccctttggaagaaaatccctttttgccaagtggggtaaaaaccaaaaggccctacccgaatggcctttcaaaaaatttgccacccctaaagggcaatggaaatttgaagggtaaaatttttgttaaaaatccgggtaaatttttggaaaaccacttattttttaccaaagggcccaaatcggaaaaccccttataaataaaagaattcccgcaaagggtttagggttgtccaatttgaaacaggtcccttttacgggcccccgtgggg

SEQ ID NO: 349382 - DNA, 738 bp, Homo sapiens
tcaacacaccttagttacaggctgagccacacccctcttgccactgctggctgatgattcgaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaa

SEQ ID NO: 349383 - DNA, 2571 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggtccaggggcttgccaggagacgcaggtcgtgaagggttcccaggacccccagggttcataggaccccgaggatccaaaggtgcaccaaacttcagggaagccatgcgcattggagcagaggtttaccacaac

SEQ ID NO: 349384 - DNA, 2719 bp, Homo sapiens
  misc_feature (1383)..(1383): n is a, c, g, or t
  misc_feature (1776)..(1776): n is a, c, g, or t
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattcccgggactgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggactgaggggttaccctggcttgagtggtgaaaaaggatcaccaggacagaagggaagccgaggcctggatggctatcaagggcctgatggaccccggggacccaagggagaagccggagacccagggccccctggactacctgcctactcccctcacccttccctagcaaaaggtgccagaggtgacccnggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccgcggaccaaaggggtggaaaggtgacgctggggaatgcagatgtacagaaggcgacgaagctatcaaaggtcttccnggactgccaggacccaagggcttcgcaggcatcaacggggagccggggaggaaaggggacagaggagaccccggccaacacggcctccctgggttcccagggctcaaggtgaggagcaatttcatcatgaagctggcaagacactctgaggcctccccaggtgtcccgttcttgccttttatctcctaagtttacacagcttcagaccggcaacactcatggacccaaggcatggctaaaccattctaaaaacccacataccccaaggcggactttctacatgtccactggtgagactgagaaggggcgctgctgtgggaaccgcagccgacagctcttgaaagagttcaatagggggtcaccacgtgacccagaaatgccactcctggtgtatccccaagagacttgaaagcacgtgtccacacaaacacacatacaccaatgttcacagcagcattcttcaaaataggcagaaggtgaaactatccaaatgtgcgtcacctgatgaatggatcagctaaatctatacagcatctataccacagaatagccctgaccttcacgtgggagcaaggtgctgagccataccacactgtggatgaacctggaacatgttatgccatggggattgagacccacacagaaggacacatgctatcacatggtctctcattctattcttatgaaatgtccacacaggcaacctagaaacaggaagtcgattggtggctgccacaggtggaggtgggggtgggggtggggagtacctgcttaatgggaatggggtttctttttgatataatgaagatgttctgaaattagataagagtgatggttgcacaaccttgtgaaaatactaaaaatcactgaattttatgctttaaaacagtgaactttgtgctatatgaattatatctcaaaaaaacctatcatttttaatgta

SEQ ID NO: 349385 - DNA, 654 bp, Homo sapiens
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggaatcgagcagtccctgtcctcagggatccagcgctggacgtagttggggccgttgtcccgaggccacacgatcacagtgtctctggatgccagggaggggtcctctgggaagaagttgaatggccggagc

SEQ ID NO: 349386 - DNA, 335 bp, Homo sapiens
catcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaataggtatgaaggaatcctcccttttacctttcacagtcctgagacattccacgctttcctttgtcagtgtagacgtttcccagtagagtcagatgaggatgctgttttgcctcatctgttctcgcacgtacaagggatgaccca

SEQ ID NO: 349387 - DNA, 3535 bp, Homo sapiens
ggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 349388 - DNA, 3709 bp, Homo sapiens
ggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcgggtagatccgaaacggggctggggcggagtgggaaaaggccgggtatgccttgcatgatcgcggggagctccttcctgtttttatcccacctagagaagccgggaagtaggggtttaggtccaatttgttggagtacttaaggactcgtttgcactttcttttgggggatgacagtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 349389 - DNA, 4100 bp, Homo sapiens
  misc_feature (4100)..(4100): n is a, c, g, or t
ggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaatataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatcccaaaaaaaaaaaaaaaaaaaaaaaaaaaaaaaaaaaaaaaaaaaaaaaaaaaaaaaagagagggggggcgcgcgcgcccaagaagatatctctccccgcgggggggcccaaattgtgcgcgcgcgcccccgattttttgggacaacacagagggggcccccactaaaagaggaggagcgcgtatatattataaaaaccacaagagcggcgagggacccccgcgtcttataaaacaaacgagcgcagagagcggggaaaacaacatcgcacaacgggggagaccaaccttggggagaaggagaacacctcaaatctagcgcggggggggagagaaacacattagtggggccacacacctatctcctcttgaagagttattttaagagggcttatggggggggaaaattataaaaaatttataagaggggtgttataagcggggtgtgtataaaacaactaaggaggtgaaaatagatgtgtgggagggatgtaagaaaaaaattgtggcgcatcaaaagagaagttttgtgacttttagggaagaattttttattaccgggggggagcattgtgttatataagn

SEQ ID NO: 349390 - DNA, 3289 bp, Homo sapiens
ggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 349391 - DNA, 3428 bp, Homo sapiens
ggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 349392 - DNA, 3239 bp, Homo sapiens
ggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 349393 - DNA, 478 bp, Homo sapiens
tcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactgggtaagtggagtcctcacttggccctctcagtgttttactgcttttcgattccttgtatccctaggctgtgaggaggtccccctgcctggggggatgggcacgggaggtggaatagatggaatggcaagacctgggttagctctgataggaaaagaaaaatatgtgcaggagaacatgagaggtggggtggggcagtgcttataaaacaaccggagtgagcatgtc

SEQ ID NO: 349394 - DNA, 410 bp, Homo sapiens
ttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatcccagctctccctctgatgttgtgtgaccttaaggagtgtaaatggcaccttagtttcagggtcacttgggtatgagcattggatattcccatccccacctcagtaactgaaggacaaaccaagataagtgtgtctatct

SEQ ID NO: 349395 - DNA, 4116 bp, Homo sapiens
  misc_feature (4116)..(4116): n is a, c, g, or t
ggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatcccaaaaaaaaaaaaaaaaaaaaaaaaaaaaaaaaaaaaaaaaaaaaaaaaaaaaaaaagagagggggggcgcgcgcgcccaagaagatatctctccccgcgggggggcccaaattgtgcgcgcgcgcccccgattttttgggacaacacagagggggcccccactaaaagaggaggagcgcgtatatattataaaaaccacaagagcggcgagggacccccgcgtcttataaaacaaacgagcgcagagagcggggaaaacaacatcgcacaacgggggagaccaaccttggggagaaggagaacacctcaaatctagcgcggggggggagagaaacacattagtggggccacacacctatctcctcttgaagagttattttaagagggcttatggggggggaaaattataaaaaatttataagaggggtgttataagcggggtgtgtataaaacaactaaggaggtgaaaatagatgtgtgggagggatgtaagaaaaaaattgtggcgcatcaaaagagaagttttgtgacttttagggaagaattttttattaccgggggggagcattgtgttatataagn

SEQ ID NO: 349396 - DNA, 3116 bp, Homo sapiens
ggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaacctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 349397 - DNA, 1870 bp, Homo sapiens
ggaaaggtgtacgcaggcgcagtggcgtctaaatttgggcccactaaatgcgtcggagcatctccgcgcccaggcggctcctcctcactgcggcaacccgggaaaacttgtgaactaatcagaaaaagtggaaggcgggagatcttggggcgctgtccaatggcgcggaagagaacaaatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaactggcacatccaagggatgcagagcatcgtgaaaggacagaaagagagaccctggcctcgaggagaacacctgtcaggttatgaagaggcatcctaattgatttttaaattcaagagatttatcgagcaccttctataagccagcggctatacaaagtggacaaagagccctgactccagcatgacagaagtgctatttggcacttgtcttcaagttgccacttggatctcttccagtgcactttcttttttcctgcctataacttttaataataaacttccactcctgctctgaaaaataaaaaagtaaataaaata

SEQ ID NO: 349398 - DNA, 2094 bp, Homo sapiens
gcggcatactcagcggcagagacggaagaacagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattgatttgtttccatgtgtgactcagaggtgagaattttttcacattatagtagcaaggaattggtggtattatggaccgaactgaaaattttatgttgaagccatatcccccatgattatatagttatgcatcacttaatatggggatattttctgggaaatgcattgctagtcaattttttttgtgccaacatcatagagtgtatttacaaaatcctagatggcatagcctactacacacctaatgtgtatggtatagactgttgctcctaggctacagacatatacagcatgttactgaatactgtaggcaatagtaacagtggtatttgtatatcgaaacatatggaaacatagagaaggtacagtaaaaatactgtaaaataa

SEQ ID NO: 349399 - DNA, 857 bp, Homo sapiens
ccaggtatgatactgattatgtttttattttatctatgttctttttggtgccaattaacattattatttaaaagctcatgggctttgttttcatattgatccacctgagaagcaaagtttttggttcaaaataaccctagaatatgtagggaacttatttgaatttgcttagtatagtaagactaagaatataaaacaattacagtaataattgatcaaatttatgtattattgattagtggaggttattagaaaatctgggggaggaacgctgagtagatacttgggcagactctggtttcagagccactttctgctcctgatcctctctttagctttttctccactctgagactccattcagtcttgaaaattctccttccccaacccctgcacacttctatttccctcttgagagtaaaatagaagcaagaatatagaggcaagatacatacactcaattggatgaagagtgattgtgaatcactaaataaaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattga

SEQ ID NO: 349400 - DNA, 2271 bp, Homo sapiens
gcggcatactcagcggcagagacggaagaacagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattgaaaaaaaaaaaaaaaaaaaaaaaaaaaaaaaaaaaaaaaaaaaaaaaaaaaaaaaaaaaaaaaaaaaaaaaaaaaaaaaaaaggggggcgccccccaaacccccgcaagggacgcccaccacagaccccccccccccactccgagaaaaagaggagcccccccagacagcgcgcccccatcacacaacaacacccagccaccgcggccaaccctcccaacaagcacacgtgaggccggcaacaacacagccccacacacgcgcggcacccttcaacacaacagcacgacgaacagcctacgtcgaaaagccccgaccagaagaggacgaacaaaaacagaaactatcgaccaccataccagcacagaagccacacacacaccaagccagtacgacgacggaacaagaaaacaagaacaccacaacgccgaacgcagcgacatagaacacggaaaccgacgaccgcaacagcgactcaaacagacccacacaactcccgcacgcacgacaccacccacaaacaacccccgccgacagcagagacaaccaacgcccccgggaga

SEQ ID NO: 349401 - DNA, 1792 bp, Homo sapiens
gcggcatactcagcggcagagacggaagaacagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtaagagggaattttaccttattcctttaaattgctgattagaacatcttgatgcaaacattaacttttaaggggagccttataactgtttcacttatacttcataaaaggaattgtaaatgagctccagccaagcattgtggctcacactgtaattccagcactttgggaggctaaggcaggaggatgtcttgaggccagaagtttgagactagcctgggcaacatagcaagacccctgtctacaaaaattttttttaaagttagctgagcatggtggcacgcacctgtagtcctagttgctcgggaggctgaggcaggaggattgcttgagcccagtaggtcaagactacagtaagctatgactgcaccacttcagcctgtctctgaaaaaataaaataaaatataataaaataaaatgaatttcaccaatgacaaaaaaa

SEQ ID NO: 349402 - DNA, 1543 bp, Homo sapiens
gcggcatactcagcggcagagacggaagaacagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattga

SEQ ID NO: 349403 - DNA, 1361 bp, Homo sapiens
ccaggtatgatactgattatgtttttattttatctatgttctttttggtgccaattaacattattatttaaaagctcatgggctttgttttcatattgatccacctgagaagcaaagtttttggttcaaaataaccctagaatatgtagggaacttatttgaatttgcttagtatagtaagactaagaatataaaacaattacagtaataattgatcaaatttatgtattattgattagtggaggttattagaaaatctgggggaggaacgctgagtagatacttgggcagactctggtttcagagccactttctgctcctgatcctctctttagctttttctccactctgagactccattcagtcttgaaaattctccttccccaacccctgcacacttctatttccctcttgagagtaaaatagaagcaagaatatagaggcaagatacatacactcaattggatgaagagtgattgtgaatcactaaataaaggtaaaaatgaacctcttgtctacaattttgtttgaactactaatcactccttcccaatagaaagtgggtgagataaagagataaatttggagacatttgcatgtatgtttttaatttcaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattgatttgtttccatgtgtgactcagaggtgagaattttttcacattatagtagcaaggaattggtggtattatggaccgaactgaaaattttatgttgaagccatatcccccatgattatatagttatgcatcacttaatatggggatattttctgggaaatgcattgctagtcaattttttttgtgccaacatcatagagtgtatttacaaaatcctagatggcatagcctactacacacctaatgtgtatggtatagactgttgctcctaggctacagacatatacagcatgttactgaatactgtaggcaatagtaacagtggtatttgtatatcgaaacatatggaaacatagagaaggtacagtaaaaatactgtaaaataa

SEQ ID NO: 349404 - DNA, 977 bp, Homo sapiens
ccaggtatgatactgattatgtttttattttatctatgttctttttggtgccaattaacattattatttaaaagctcatgggctttgttttcatattgatccacctgagaagcaaagtttttggttcaaaataaccctagaatatgtagggaacttatttgaatttgcttagtatagtaagactaagaatataaaacaattacagtaataattgatcaaatttatgtattattgattagtggaggttattagaaaatctgggggaggaacgctgagtagatacttgggcagactctggtttcagagccactttctgctcctgatcctctctttagctttttctccactctgagactccattcagtcttgaaaattctccttccccaacccctgcacacttctatttccctcttgagagtaaaatagaagcaagaatatagaggcaagatacatacactcaattggatgaagagtgattgtgaatcactaaataaaggtaaaaatgaacctcttgtctacaattttgtttgaactactaatcactccttcccaatagaaagtgggtgagataaagagataaatttggagacatttgcatgtatgtttttaatttcaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattga

SEQ ID NO: 349405 - DNA, 1710 bp, Homo sapiens
gcggcatactcagcggcagagacggaagaacagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtacacatccaagcctaaagaaaaattagtctatgccatttttcttaaatggcccacatcaggacagctgttccttggccatcccaaagctattctgggggcaacagaggtgaaactactgggccatggacagccacttaactggatttctttggagcaaaatggcattatggtagaactgccacagctaaccattcatcagatgccgtgtaaatggggctgggctctagccctgactaatgtgatctaaagtgcagcagagtggctgatgctgcaagttatgtctaaggctaggaactatcaggtgtctataattgtagcacatggagaaagcaaatgtaaaactggataagaaaattattttggcagttcagccctttccctttttcccactaaattttttcttaaattacccatgtaaccattttaactctccagtgcactttgccattaaagtctcttcacattga

SEQ ID NO: 349406 - DNA, 1247 bp, Homo sapiens
gcggcatactcagcggcagagacggaagaacagcgctcccgaggccgcgggagcctgcagagaggacagccggcctgcgccgggacatgcggccccaggagctccccaggctcgcgttcccgttgctgctgttgctgttgctgctgctgccgccgccgccgtgccctgcccacagcgccacgcgcttcgaccccacctgggagtccctggacgcccgccagctgcccgcgtggtttgaccaggccaagttcggcatcttcatccactggggagtgttttccgtgcccagcttcggtagcgagtggttctggtggtattggcaaaaggaaaagataccgaagtatgtggaatttatgaaagataattaccctcctagtttcaaatatgaagattttggaccactatttacagcaaaattttttaatgccaaccagtgggcagatatttttcaggcctctggtgccaaatacattgtcttaacttccaaacatcatgaaggctttaccttgtgggggtcagaatattcgtggaactggaatgccatagatgaggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaaggtacagtgaaatgtctggtggctattaacataatattcttaatagtgtggtcatgtaggaattatttcttctatggctcaatggcctataaatataggacattgttctatcctgtgtttgttcttctaggcagtgactatatatacatgtataaatatataaatgcacatattagcacattaaagatggaattatttt

SEQ ID NO: 349407 - DNA, 3738 bp, Homo sapiens
  misc_feature (1735)..(1735): n is a, c, g, or t
ctgaagcccatttcctacacgtagcaccatttatttaaaacacacactacatatacacaacagaccaaatgcaaaggaaaaaaggggaaaaaggctgctgaagaccagagtcactaaaagttcaggctaagaatagacaaggaactctgagagctgctcagctatgtgacctcctgcaggggcttggcaagaagcccaattcagctttgttttttctgtgcttttacaaagaaagagcactagcttgggagtcaggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctttggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgancgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatcccctactggttctgcttctctagttgaatctgactgatacagattttggtgccaaaagtggttctagaaaaatagaatcttaaagatgagttttctgcattggttctggatttttttagaattcttccctagtttgattgaacttaaaggcatc

SEQ ID NO: 349408 - DNA, 3718 bp, Homo sapiens
  misc_feature (1735)..(1735): n is a, c, g, or t
ctgaagcccatttcctacacgtagcaccatttatttaaaacacacactacatatacacaacagaccaaatgcaaaggaaaaaaggggaaaaaggctgctgaagaccagagtcactaaaagttcaggctaagaatagacaaggaactctgagagctgctcagctatgtgacctcctgcaggggcttggcaagaagcccaattcagctttgttttttctgtgcttttacaaagaaagagcactagcttgggagtcaggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctttggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgancgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 349409 - DNA, 3708 bp, Homo sapiens
  misc_feature (1735)..(1735): n is a, c, g, or t
ctgaagcccatttcctacacgtagcaccatttatttaaaacacacactacatatacacaacagaccaaatgcaaaggaaaaaaggggaaaaaggctgctgaagaccagagtcactaaaagttcaggctaagaatagacaaggaactctgagagctgctcagctatgtgacctcctgcaggggcttggcaagaagcccaattcagctttgttttttctgtgcttttacaaagaaagagcactagcttgggagtcaggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctttggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgancgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 349410 - DNA, 2423 bp, Homo sapiens
gcagaacacctccctggagaattgcaactaagatgtttatggcaatcgccctgcaagtgtctatttaattcctgaaaatgtcatttactggtgtgtttctgtaaaaatcatttctgaaaagttttgtcagcttggcttagcagctgggggaaaaaagcagcaaaatgagtcccctcaatcaagcctgtgattttttattttttcagactcatgaatcctcctgagaattaggcttatgacaagcacccaccccctccacctactccctggtttaaaccaggtgcctgctgacacgaaggaagattccggggcattttgatcctagtcacacagtgtttctaagtgggcattactcctgtcaatccacagtcttaaagatgttcctcagacgcgggccagagaaggacagggtctctggttggggccgtgtctcccatcgcattctccctttgcaggtgctgaagtgaggaaggcccacagctcagccaagcacatggggtgcctccctcctgggccactagcccactggccagtaagagaaccagggagcctttacttagagactcaaggttcagaagagggaaatgggaagtcactgtgaaatggcccagcttggaggaggtgaccctgctgccgaatctgaccccttatcctattacctaagttcctttcttgtttactggccctgaaatcacccgctttggagattgccttgcaaggcagcatagcagagtaggagagttagggtagggcaggtacagcctgtgctcagccctcacaggccctgcacaagcccaccaggcccccggctcccttctggcattcaccaggagagggtctgcccagcccagcaggtgggttccaggagaagggatggaggtgggaagtggtggttatggaactcctaccacttggatcttcacctgcatggtcattcagtcttcatagtcttcttttgaggacatttcagaaaaggaaactgaggctcaggatgaggatttgatccagggctgctaattcttctgacagagcacagccacgtggcttatgcctgcagcaggcccttcccaaaggctgttcaggccagggcaaggtgctgaggacaggctggcctggttgcaggtttggggtgtgaccggtgagtctcctggttgtccccaccactggcccaggaaagcctgcagccaggccaggctctgtccccaccactggcccaggaaagcctgcagccaggccaggctcagggctgagcatccactgagtctgcctggaaagtcggcaacctggttcctcttggtcctctcttacagcgagtccctgtggcccatcgaggccagaaacgcagccattgccaatcactgcttcacctgcgccatcaatcgagtgggcaccctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 349411 - DNA, 1592 bp, Homo sapiens
agtccctgatcctagttaacttactgcaaatagagatgcagaaagggcaggggaatgagcgtccactgggtgcctgctgcatctgggccatgctaggccctgcccagccccacctgctccttacacatgtgtggggtggctgctagtcctccctgactggtgaagggaccaaggcctggagggaggataagggtgacgcagctggcaaggcagatgaaggcagagcctccagctcactgtgagggcccccataggaagcccccagagtgtgactttctgttttccttaggctgtgggtagaagtgacacctctcagaagggtgacatttagacatttccccaggggcaaagggaagcagcataagggggccatttgcagcaatttgctgggccttcaggcctgagatgagagacaggccttttgggcctcagcatttggcagacactggggaggatggcatggactccgtgtcctgggcctgcctcaaggtgcctgaccctctgtggagcccacagtgcatctacacaagctcacagatgtgtttctttgttcctttaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 349412 - DNA, 3655 bp, Homo sapiens
  misc_feature (1735)..(1735): n is a, c, g, or t
ctgaagcccatttcctacacgtagcaccatttatttaaaacacacactacatatacacaacagaccaaatgcaaaggaaaaaaggggaaaaaggctgctgaagaccagagtcactaaaagttcaggctaagaatagacaaggaactctgagagctgctcagctatgtgacctcctgcaggggcttggcaagaagcccaattcagctttgttttttctgtgcttttacaaagaaagagcactagcttgggagtcaggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctttggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgancgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaatgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 349413 - DNA, 3346 bp, Homo sapiens
  misc_feature (1735)..(1735): n is a, c, g, or t
ctgaagcccatttcctacacgtagcaccatttatttaaaacacacactacatatacacaacagaccaaatgcaaaggaaaaaaggggaaaaaggctgctgaagaccagagtcactaaaagttcaggctaagaatagacaaggaactctgagagctgctcagctatgtgacctcctgcaggggcttggcaagaagcccaattcagctttgttttttctgtgcttttacaaagaaagagcactagcttgggagtcaggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctttggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgancgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgtaagtcccgaggtctggctggggagaggagccaccacctggtggctctggtggggacaccccgttccctctgcacacatgccacaaatcctagggtccggaaaggggtaaaactggcttggtccgttacttttcaagatatctctgtcctcctgttttttctgtttttgtatttggctgaagcccttttattttccccattgaccccatacacttaacagttttgactgccaaacagaatgcacttattatatctcttcctcatccttattaatcagatagcaaactctaatcagaagatcttttcagtctgagataaccaaggtttctacactaagtctatctgacttctagcagcataaagaaacctgatgttttggctgggtttggtggctcatgcttgtaatcctaacactttgggaatccgaggctggcagatcacctgaggtcagaagtttgaaaccagcctggccagtgtggcaaaaccctgtctctactaaaaatataaaaattagcagggcaggctggcacgtgcctgtgattccagctactcaggaggctggggcacgagaatagcttgaacaaggaggcagaggttgcagtaagccaggatcgcgccactgcactccagcttgggtgacagagtgagactctgtcaa

SEQ ID NO: 349414 - DNA, 2105 bp, Homo sapiens
gcagaacacctccctggagaattgcaactaagatgtttatggcaatcgccctgcaagtgtctatttaattcctgaaaatgtcatttactggtgtgtttctgtaaaaatcatttctgaaaagttttgtcagcttggcttagcagctgggggaaaaaagcagcaaaatgagtcccctcaatcaagcctgtgattttttattttttcagactcatgaatcctcctgagaattaggcttatgacaagcacccaccccctccacctactccctggtttaaaccaggtgcctgctgacacgaaggaagattccggggcattttgatcctagtcacacagtgtttctaagtgggcattactcctgtcaatccacagtcttaaagatgttcctcagacgcgggccagagaaggacagggtctctggttggggccgtgtctcccatcgcattctccctttgcaggtgctgaagtgaggaaggcccacagctcagccaagcacatggggtgcctccctcctgggccactagcccactggccagtaagagaaccagggagcctttacttagagactcaaggttcagaagagggaaatgggaagtcactgtgaaatggcccagcttggaggaggtgaccctgctgccgaatctgaccccttatcctattacctaagttcctttcttgtttactggccctgaaatcacccgctttggagattgccttgcaaggcagcatagcagagtaggagagttagggtagggcaggtacagcctgtgctcagccctcacaggccctgcacaagcccaccaggcccccggctcccttctggcattcaccaggagagggtctgcccagcccagcaggtgggttccaggagaagggatggaggtgggaagtggtggttatggaactcctaccacttggatcttcacctgcatggtcattcagtcttcatagtcttcttttgaggacatttcagaaaaggaaactgaggctcaggatgaggatttgatccagggctgctaattcttctgacagagcacagccacgtggcttatgcctgcagcaggcccttcccaaaggctgttcaggccagggcaaggtgctgaggacaggctggcctggttgcaggtttggggtgtgaccggtgagtctcctggttgtccccaccactggcccaggaaagcctgcagccaggccaggctctgtccccaccactggcccaggaaagcctgcagccaggccaggctcagggctgagcatccactgagtctgcctggaaagtcggcaacctggttcctcttggtcctctcttacagcgagtccctgtggcccatcgaggccagaaacgcagccattgccaatcactgcttcacctgcgccatcaatcgagtgggcaccgtaagtcccgaggtctggctggggagaggagccaccacctggtggctctggtggggacaccccgttccctctgcacacatgccacaaatcctagggtccggaaaggggtaaaactggcttggtccgttacttttcaagatatctctgtcctcctgttttttctgtttttgtatttggctgaagcccttttgaaaagatctttgacatggcagttctcaccctatcacctccaagtatccagtttattttccccattgaccccatacacttaacagttttgactgccaaacagaatgcacttattatatctcttcctcatccttattaatcagatagcaaactctaatcagaagatcttttcagtctgagataaccaaggtttctacactaagtctatctgacttctagcagcataaagaaacctgatgttttggctgggtttggtggctcatgcttgtaatcctaacactttgggaatccgaggctggcagatcacctgaggtcagaagtttgaaaccagcctggccagtgtggcaaaaccctgtctctactaaaaatataaaaattagcagggcaggctggcacgtgcctgtgattccagctactcaggaggctggggcacgagaatagcttgaacaaggaggcagaggttgcagtaagccaggatcgcgccactgcactccagcttgggtgacagagtgagactctgtcaa

SEQ ID NO: 349415 - DNA, 3761 bp, Homo sapiens
  misc_feature (1735)..(1735): n is a, c, g, or t
ctgaagcccatttcctacacgtagcaccatttatttaaaacacacactacatatacacaacagaccaaatgcaaaggaaaaaaggggaaaaaggctgctgaagaccagagtcactaaaagttcaggctaagaatagacaaggaactctgagagctgctcagctatgtgacctcctgcaggggcttggcaagaagcccaattcagctttgttttttctgtgcttttacaaagaaagagcactagcttgggagtcaggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctttggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgancgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 349416 - DNA, 3837 bp, Homo sapiens
  misc_feature (1735)..(1735): n is a, c, g, or t
ctgaagcccatttcctacacgtagcaccatttatttaaaacacacactacatatacacaacagaccaaatgcaaaggaaaaaaggggaaaaaggctgctgaagaccagagtcactaaaagttcaggctaagaatagacaaggaactctgagagctgctcagctatgtgacctcctgcaggggcttggcaagaagcccaattcagctttgttttttctgtgcttttacaaagaaagagcactagcttgggagtcaggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctttggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgancgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggacggcagggctcggtcacgctggacacagtttccagatctacaccacaccgagatggctcaagccaagtggccagagctatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 349417 - DNA, 2466 bp, Homo sapiens
gcagaacacctccctggagaattgcaactaagatgtttatggcaatcgccctgcaagtgtctatttaattcctgaaaatgtcatttactggtgtgtttctgtaaaaatcatttctgaaaagttttgtcagcttggcttagcagctgggggaaaaaagcagcaaaatgagtcccctcaatcaagcctgtgattttttattttttcagactcatgaatcctcctgagaattaggcttatgacaagcacccaccccctccacctactccctggtttaaaccaggtgcctgctgacacgaaggaagattccggggcattttgatcctagtcacacagtgtttctaagtgggcattactcctgtcaatccacagtcttaaagatgttcctcagacgcgggccagagaaggacagggtctctggttggggccgtgtctcccatcgcattctccctttgcaggtgctgaagtgaggaaggcccacagctcagccaagcacatggggtgcctccctcctgggccactagcccactggccagtaagagaaccagggagcctttacttagagactcaaggttcagaagagggaaatgggaagtcactgtgaaatggcccagcttggaggaggtgaccctgctgccgaatctgaccccttatcctattacctaagttcctttcttgtttactggccctgaaatcacccgctttggagattgccttgcaaggcagcatagcagagtaggagagttagggtagggcaggtacagcctgtgctcagccctcacaggccctgcacaagcccaccaggcccccggctcccttctggcattcaccaggagagggtctgcccagcccagcaggtgggttccaggagaagggatggaggtgggaagtggtggttatggaactcctaccacttggatcttcacctgcatggtcattcagtcttcatagtcttcttttgaggacatttcagaaaaggaaactgaggctcaggatgaggatttgatccagggctgctaattcttctgacagagcacagccacgtggcttatgcctgcagcaggcccttcccaaaggctgttcaggccagggcaaggtgctgaggacaggctggcctggttgcaggtttggggtgtgaccggtgagtctcctggttgtccccaccactggcccaggaaagcctgcagccaggccaggctctgtccccaccactggcccaggaaagcctgcagccaggccaggctcagggctgagcatccactgagtctgcctggaaagtcggcaacctggttcctcttggtcctctcttacagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttggggtgaggaagacacctctgccccagtggattagcaagtgtggcaggcttaacatgtccaggttctccccaataacattgtccaggttggttttaaaattcccaggcagggggagagtggcatggggagtgacttcttaatgggtaaggggctgcttacttctggggtattggaaatgtttggggactaggtagaggtgaatgtactaaatgccactgaatttgtatacttcagaatgtttgttatgtaaattttacctcaactaaaaaaaaaaaatgcccaggtactgcttgtgcaggtggatttgaggttaggcagatgatgctgtccatcccgtacaccagtgggaagagggtgagggctgatccagagaccctgagcctacagcaaggctgtggtgggtcggatggtctttggatgtgtcagcttagctaggccacagtcaccagtaattcaatcagacactaatctaggtatttctgtgaaggtattttgtagatgtgacagaagtccattcccaattgactaagtaagtgagattatctcagataatctgggtcagcctgacctgattagtcagaaggcctaaagaacagagctaagggtttccctgaggaagaaattctgcctgaggacagcagcccagtgcttggcgagagttcctgacagtctgcccttctgatagcctgcctcacagagtttagacatgactagccagctcctacaatcactgaagtcaattccttgcaataaatctcaatatatccccta

SEQ ID NO: 349418 - DNA, 3249 bp, Homo sapiens
  misc_feature (1735)..(1735): n is a, c, g, or t
ctgaagcccatttcctacacgtagcaccatttatttaaaacacacactacatatacacaacagaccaaatgcaaaggaaaaaaggggaaaaaggctgctgaagaccagagtcactaaaagttcaggctaagaatagacaaggaactctgagagctgctcagctatgtgacctcctgcaggggcttggcaagaagcccaattcagctttgttttttctgtgcttttacaaagaaagagcactagcttgggagtcaggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctttggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgancgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgagcacttcccgaacgagtttacctcgggagatggaaagaaagctcaccaggactttggctacttttatggctcgagctatgtggcagcccctgacagcagccggactcctgggctgtcccgtagccgggatggactgctagttgctaagctcgacctaaacctctgccagcaggtgaatgatgtctggaacttcaagatgacgggcaggtatgagatgtacgcacgggagctcgccgaagctgtcaagtccaactacagccccaccatcgtgaaagagtagccggcttcagtgcctgccttgggctgtttctgagggtgaacagccacagcagccctgtggacaccatgaggcttccacttcatcagaccatcagtgaaccaggccctggcatttaggagaacctctgtgaacttaggttcctgttgacccagtgactttgctttggtggagtgggggatataagtgtcccccaaagggttagctgccagttttttcatgtaaaactgagatgtcagcagggctagactagctgtgttcttaaatataccatttccatctt

SEQ ID NO: 349419 - DNA, 3400 bp, Homo sapiens
  misc_feature (1735)..(1735): n is a, c, g, or t
ctgaagcccatttcctacacgtagcaccatttatttaaaacacacactacatatacacaacagaccaaatgcaaaggaaaaaaggggaaaaaggctgctgaagaccagagtcactaaaagttcaggctaagaatagacaaggaactctgagagctgctcagctatgtgacctcctgcaggggcttggcaagaagcccaattcagctttgttttttctgtgcttttacaaagaaagagcactagcttgggagtcaggagacctaggtaccagactttgctttgccagtgcctctttctgtggccttgggtaagtttttcccctctctgggcctcagtttcccatttgcaaaataaaagtgtttaagactaggttccaagattttccaattctaatgctgagaggatacagaggaaaacagaaagaatgctggctgaggaaccaggagacttgccttcttgtcccagctctgccactgacctgacctctttgggcctctgcttcctcatctataaaataagataaagcaacagaagcctccagcgactaagttaaactttcctggggtcacaaggtttacaagtggctgaataggatttctacagactggttccttcacccggctgcccgccgaagtaagcgggccttactgccctaattctcaataggaccccaaagaggacgcttctttgctcctgaagggatggcaccctttggattcgcggtaacagcaaatggggctctcactcctaccatctcagtgacagtttaaagcgcaccctaccgcaggaaagtgcccatatttgcacacacgcggcagagggcagggctgaaaaggggccctagggtgcagggggcgcgccctcacccggggaccccgcattttacaatattagctccaccgaggcgcacggaaccgcaggcgagcaactgaccttcggctccagcggccccaaagccgggggtgggaacgcgcgacccaggtagcggcatggactccgagcctggcccctcgggggttaaaactccccagacataaaggctccggacgacagaggtgcagccgccgcgtgcccgtgggacactgaaactcttcccttaccttcctcggtagtcctgtgagggaggctggcccggccggctgccctacggtgcggacaggaggtcgcggtcgggaggggccctgcccggcggttgctgctggaaccagcccccgcaagggcccgcagcggccgggccgtttacctcagacccgcgccgcagcctcccggagcccgcgcccaggactccctcacgacctctccagggtcccggcccgacaccaaggggcaggtgaggggtggaacctggaggcacccgcgccagggcccctgagggaggcgggagggggacagcctcagtcctgactcgcagccgaggcgcgacgactccgcgcagtcccgcctgtggaggggcgtgcctcatcgcttgctaaccgagaggcgaagggcaaggggcgaagggcaagcgccggatcctttcgccccctccccacgtgaggccctggaggctgattggccgtgtgctgcggaggcggcaagaggaacgtgtcctggcacgtgccgaaggagcgctaaaggccaggggcggtcccacccgcgaagccctggaaggcggattggctgcgcgaggaagtggcgtgtcctcacttgagctgtctgggagcgagagtaagagataaaggcaagggcgcctgancgggcctgggcacctcctcccactgcgggcaaagggcaggcagttcgtgcgcggacacaagcactggcggaccgtggccatggcgggcgctgagtggaagtcgctggaggaatgcttggagaagcacctgccgctccccgacttgcaggaagtgaagcgcgttctctatggcaaggaactcaggaagcttgatctgcccagggaagctttcgaagctgcctccagagaagactttgaactgcagggatatgcctttgaagcagcggaggagcagctgagacgaccccgcattgtgcacgtggggctggttcagaacagaatccccctccccgcaaatgcccctgtggcagaacaggtctctgcccttcatagacgcataaaggctatcgtagaggtggctgcaatgtgtggagtcaacatcatctgtttccaggaagcatggactatgccctttgccttctgtacgagagagaagcttccttggacagaatttgctgagtcagcagaggatgggcccaccaccagattctgtcagaagctggcgaagaaccatgacatggtggtggtgtctcccatcctggaacgagacagcgagcatggggatgttttgtggaatacagccgtggtgatctccaattccggagcagtcctgggaaagaccaggaaaaaccacatccccagagtgggtgatttcaacgagtcaacttactacatggagggaaacctgggccaccccgtgttccagacgcagttcggaaggatcgcggtgaacatttgctacgggcggcaccaccccctcaactggcttatgtacagcatcaacggggctgagatcatcttcaacccctcggccacgataggagcactcagcgagtccctgtggcccatcgaggccagaaacgcagccattgccaatcactgcttcacctgcgccatcaatcgagtgggcaccgtaagtcccgaggtctggctggggagaggagccaccacctggtggctctggtggggacaccccgttccctctgcacacatgccacaaatcctagggtccggaaaggggtaaaactggcttggtccgttacttttcaagatatctctgtcctcctgttttttctgtttttgtatttggctgaagcccttttgaaaagatctttgacatggcagttctcaccctatcacctccaagtatccagtttattttccccattgaccccatacacttaacagttttgactgccaaacagaatgcacttattatatctcttcctcatccttattaatcagatagcaaactctaatcagaagatcttttcagtctgagataaccaaggtttctacactaagtctatctgacttctagcagcataaagaaacctgatgttttggctgggtttggtggctcatgcttgtaatcctaacactttgggaatccgaggctggcagatcacctgaggtcagaagtttgaaaccagcctggccagtgtggcaaaaccctgtctctactaaaaatataaaaattagcagggcaggctggcacgtgcctgtgattccagctactcaggaggctggggcacgagaatagcttgaacaaggaggcagaggttgcagtaagccaggatcgcgccactgcactccagcttgggtgacagagtgagactctgtcaa

SEQ ID NO: 349420 - DNA, 211 bp, Homo sapiens
  misc_feature (27)..(27): n is a, c, g, or t
accacgcgtcgcggacgcgtgggtcgnccacgcgtcggaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttatacttaaaaaaaag

SEQ ID NO: 349421 - DNA, 2658 bp, Homo sapiens
gcaataaggtaacaggtgtgcccacctctcagggctgctatgaggacaactgaggccacacacctggctctcaataagtgagtggtgctctgtgagcttctggcgagtaaggggcaccctactcattgcggccgggggcctcccccagcaaacgggtggaaagaggcctgagccccatccccagtttctgcccctgctatctccacccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggagatgtgaccgactgcagaggccgcgccgcctcccccgtccgaggtctgcgcgctccgccgcagggtgcagacccggggcgcccgcctgggtttggggcgcaagagcagaggcggagccagggcggagccagcgcgccgggtcccccctgaatcgaaagcgaaacaggggccggggaggaagggcggagccggccccgaggcaccgccccctgccctgcgcggctgctggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggtgagggcgctgacccccagctccccctcagccctgccctaccccagccctgcccctccctgccctggccccaccctggcccagcctcgccctcggaccctcacagccctgcccgcccccaggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttatacttaaaaaaaag

SEQ ID NO: 349422 - DNA, 1226 bp, Homo sapiens
  misc_feature (27)..(27): n is a, c, g, or t
accacgcgtcgcggacgcgtgggtcgnccacgcgtcggagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttatacttaaaaaaaag

SEQ ID NO: 349423 - DNA, 2482 bp, Homo sapiens
gcaataaggtaacaggtgtgcccacctctcagggctgctatgaggacaactgaggccacacacctggctctcaataagtgagtggtgctctgtgagcttctggcgagtaaggggcaccctactcattgcggccgggggcctcccccagcaaacgggtggaaagaggcctgagccccatccccagtttctgcccctgctatctccacccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggagatgtgaccgactgcagaggccgcgccgcctcccccgtccgaggtctgcgcgctccgccgcagggtgcagacccggggcgcccgcctgggtttggggcgcaagagcagaggcggagccagggcggagccagcgcgccgggtcccccctgaatcgaaagcgaaacaggggccggggaggaagggcggagccggccccgaggcaccgccccctgccctgcgcggctgctggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaattgaacaggagtcttgattctttttttgcctcatcagagaaggaatctggactccccatccccccaccaggataaaagtcctgacctttgttctcttgacggaataaaagcttgcttatccttatacttaaaaaaaag

SEQ ID NO: 349424 - DNA, 1864 bp, Homo sapiens
  misc_feature (1085)..(1085): n is a, c, g, or t
  misc_feature (1365)..(1365): n is a, c, g, or t
gcaataaggtaacaggtgtgcccacctctcagggctgctatgaggacaactgaggccacacacctggctctcaataagtgagtggtgctctgtgagcttctggcgagtaaggggcaccctactcattgcggccgggggcctcccccagcaaacgggtggaaagaggcctgagccccatccccagtttctgcccctgctatctccacccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggagatgtgaccgactgcagaggccgcgccgcctcccccgtccgaggtctgcgcgctccgccgcagggtgcagacccggggcgcccgcctgggtttggggcgcaagagcagaggcggagccagggcggagccagcgcgccgggtcccccctgaatcgaaagcgaaacaggggccggggaggaagggcggagccggccccgaggcaccgccccctgccctgcgcggctgctggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggtaacctatcccctcccctcgcaaaggaccgggtcacgggagggagagcaagaggggggacccgacccgttcatggtgactgacccccctctgaaacaggagggaccaggcattgtcggtccataactcatcacccaatctcactttttcacctctccatcatttgtccggccagggagcctgcnaacagtaggcgctcattatgtgctgattgtattcaatgggggagagagccatgaaactaagcaatgaaaggagccaggattattgccatcatagcgggggcgcagaggtcagagaaggcttactggaggaggaggtaccaagtcttaaaggatggggaggagtgagccctgggaggggaaagggaaagaaaggcaggggtcttggggtgggggagggaatggcataagcaaaggctgggaggtggggaagggttgttagtggcagtctctagaaaggctnggatgagcagaggattggggaggagagagaggcaggggaatggaacccttgtgttgaatgaatgaatgaatgaatgaatgaatgaatgaatgaatgaatggctttgaagcacaggtgcatcatggctactttgcttctttgacagctttggtgatgggaacgctgtggatttagcctgcctgaaaggcttagtgtagggctgttaaagagtataataggccaggcgcggtggctcacgcctgcaatcccaacattttgggaggccgaggcgggcggatcacctgaggtcgggagtttgagaccagcctgaccaacatggagaaacccgtctctactaaaaaatacaaaattagctgggcatggtggcgcatgcctgtaatcccagctactcgggaggctgaggcaggagaatcacttgaacccaggaggcggaggttgcagtgagctgagatcacaccattgcactccagcctgggcaacaagagcgaaactctgtctc

SEQ ID NO: 349425 - DNA, 2536 bp, Homo sapiens
gcaataaggtaacaggtgtgcccacctctcagggctgctatgaggacaactgaggccacacacctggctctcaataagtgagtggtgctctgtgagcttctggcgagtaaggggcaccctactcattgcggccgggggcctcccccagcaaacgggtggaaagaggcctgagccccatccccagtttctgcccctgctatctccacccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggagatgtgaccgactgcagaggccgcgccgcctcccccgtccgaggtctgcgcgctccgccgcagggtgcagacccggggcgcccgcctgggtttggggcgcaagagcagaggcggagccagggcggagccagcgcgccgggtcccccctgaatcgaaagcgaaacaggggccggggaggaagggcggagccggccccgaggcaccgccccctgccctgcgcggctgctggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttatacttaaaaaaaag

SEQ ID NO: 349426 - DNA, 1804 bp, Homo sapiens
aaagaaactgaggccgaagtcacttgccagcaagcaggggcagctgcgatttgaaccctggccacctggagtcagagcctgggctctaacatgcctccgagcacaacgtggcctcaaaggggcgatatgtcacaacatcaacaagcatgtggcatttgcaggcaggaagatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttatacttaaaaaaaag

SEQ ID NO: 349427 - DNA, 2003 bp, Homo sapiens
gcaataaggtaacaggtgtgcccacctctcagggctgctatgaggacaactgaggccacacacctggctctcaataagtgagtggtgctctgtgagcttctggcgagtaaggggcaccctactcattgcggccgggggcctcccccagcaaacgggtggaaagaggcctgagccccatccccagtttctgcccctgctatctccacccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggagatgtgaccgactgcagaggccgcgccgcctcccccgtccgaggtctgcgcgctccgccgcagggtgcagacccggggcgcccgcctgggtttggggcgcaagagcagaggcggagccagggcggagccagcgcgccgggtcccccctgaatcgaaagcgaaacaggggccggggaggaagggcggagccggccccgaggcaccgccccctgccctgcgcggctgctggaccgacgggcgcacccaggtaggggggcggctgagccgcgcagtgcggaccctcgcggggaactgcgccgccgccaccatgtctcaggaaggtgtggagctggagaagagcgtccggcgcctccgggagaagtttcatgggaaggtatcctccaagaaggcgggggctctgatgaggaaattcggcagcgaccacacgggagtggggcgctccatcgtgtacggggtaaagcaaaaagatggccaagaactaagtaacgatctggatgcccaggatccaccagaagatatgaagcaggaccgggacattcaggcagtggcgacctccctcctgccactgacagaagccaacctacgcatgtttcaacgtgcccaggacgaccttatccctgctgtggaccggcagtttgcctgctcctcctgcgaccacgtctggtggcgccgcgtgccccagcggaaggaggtatcccggtgccggaaatgccggaagcgctacgagccagtgccagctgacaagatgtggggcctggctgagttccactgcccgaagtgtcggcacaacttccggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagtttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccctctgccctttacttgaacaggagtcttgattctttttttgcctcatcagagaaggaatctggactccccatccccccaccaggataaaagtcctgacctttgttctcttgacggaataaaagcttgcttatccttatacttaaaaaaaag

SEQ ID NO: 349428 - DNA, 415 bp, Homo sapiens
gcgctgtcccgtgctttagccactaggtgcctgtcactcgggagcacttgaaaagtgggtccctgccactgagcagctgaactggtcattttatttaattttaatttacttaaatttaaacagccacctgtggctgtggctaatggctacttaacccgagggcacagggttgggtgatgaagtcatattctgtgtttcggagcagggcctgggctcttggtatctgattccttccccaatgccccacctgcaccccaactttttttctgaggtagggtcttgctctgtcaccaaggctggagtgcagtggtaccatcacagctcattacagccatgaactcctgggctcaaattaacctcccgcctcagcctcccaaatagctgagacgacaggtgtacaccaccatgactggct

SEQ ID NO: 349429 - DNA, 221 bp, Homo sapiens
gagctatttatattagctctgccaaaattacatcattaaatttggccttatgaagcattgctgactgtagtaaaaacaagtgtgagcaaagtcttcatatgcactgagtctggtttcagttccacgtaatactgacttggcaagtgtggaaattctcatgtcatcattaccaaaaaaaagtgagttcacacagggatttctgatcaagtgacccattactg

SEQ ID NO: 349430 - DNA, 500 bp, Homo sapiens
agctagataagtaagaagaaatgaccagtagatctgacaggaaagtgggctcgatgtgattagccgactcccaggagaagctgataaagggcaagttctacttctttttgctcagatctggaggcaagcagagttcaggggcccataggaaaaagagaaggctttggttaagacaaagcagagggtaagaaatgggcaattgtgaatgcttagttagaaaatacaggctgggcacagtggctcatgcctgtaataccaacactttgggaggtcgaggtgggtggatcacgaggtaaggagattgagaccatcctggctaaaatggtgaaaccttgtctctactaaaaatataaaaaattagctcggcatggtgacatgtgcctgtaatcccagccactctggaggctgaggcagaagaatcgcttcaacccaggaggcggaggttccagtgagccgagatggtgccactgcactccagcctgggcaacagagcaagacac

SEQ ID NO: 349431 - DNA, 503 bp, Homo sapiens
gcatgtatgtttacacatgcacacacactcccaggctggatgcccagaaccccactgtgatcaatattgaacgactggagaaatactccactccttccacccactgggcctctcttgattatctgctgtacaccaagctgcttcatttccatagctcctgagaatctgctgacaaagaattagccctggcccagcttccccatcctgaggacgccttggcttccagcattacagctcattaggtggagagaggtttgcatgcaaggcaagtggaaagggggtcccatcccttccacttccttctttctcccagctagcaaattccaagccgagactgtccatgctccagagaggatttctgctgccacagaggaggggaaggtggggagaaggttggctcctgctctgtgcctccccatctggatctcatcattattttcaaggaggcttatctgcttcagcatcctgtcccaattaaaaaccaactcagtttatgtttccag

SEQ ID NO: 349432 - DNA, 257 bp, Homo sapiens
ccatcttcatgcacctgattcctgaagctccccctgccatttccaggagaaaatacactttcctagccacttctcatcagaggccctctgttttcctacctattgctgccacataaagaagaggtcaaagagggtcaggccctggcagcacttctaggtatttgcaggtgggaaggaacccctccaaacaacactgccttagccaggcatggtagcacatgtctgtagtcccagctactcagaggcagaggcaggag

SEQ ID NO: 349433 - DNA, 551 bp, Homo sapiens
tagaacgttactgctccaatgattcagtgaggatctcgaaatgaattctgaagtcttccaatgtttgcatttattggaggggctcccgagttctatcaacttgttttttcaagtcttgttctcatcttgtgcataaatgttaacgcttcccaaagtaaaaacttagctttcttacttttactttttattaaatttaatacaaaatatgacctgagtagttaaaaaatattttacattatttgcagtaagatgtcattagccctttcaaagagcaaattttaaaacttcaatctgggtgaaagattggctagttttatagaaagatttgccgtcttaaactcaagctgatttttctatttttatgtaaataactgagatgccatcttattaattcttccaaggtcatgtttgtaaaataaacattacatgagagctttcctgtcatctacactgtatgttgtttagagtgttgaacaaatttgagttcctaagttgtaatctgtcctcatgtggtctatgctatttgcacgtgtgccactacacgctgagat

SEQ ID NO: 349434 - DNA, 470 bp, Homo sapiens
tctctaaaggaccatcaggtgaaagttacatgaagccataaacttaatatggagagtacttttctaaccttttataaagtggggtaaatgaaatggggttctctattaaatagtggactcctaatccctgcaagtagtaaagcaaaaaaaaaaaacaaacaaaaaacttttaaactacatatataggatataataaagcaaatccaatgacaaaaggtatgctgaggtgtcaaaatacagggcgaaaacacaggaggaagtgtttaaatatgactaagaaatctaagaagacttttggaggaggcagcatttaagctgggcattcatttacacacaggtctttactaccctagcttgaaatttaaggttcagagcaataaactaaaaaaagaatttattttttctaattccaacttcactcctcttaaaaattctgcccttcctctgaattaaatgtatacacaaaaaca

SEQ ID NO: 349435 - DNA, 698 bp, Homo sapiens
gaaggtgggtctgtaaagcaggtggactctgggcattgctgtgggtgcaaacttcccttaggaagagcctggtgatttgtgaggaaatgacctcattgttaaaaagaagaatgcatccaggatccttattatgtctgctgagaatgacccttcatggactctggaatctggagcaggtggggagagaggtcaagaagggctgtttctcctttaactctcacccaagcttgcccaaaggggaccatgtgactggcattcatgggctagtcagaagagagaaatgtagtgcccctctgtcttatacctgctaaggatgctaaggggggtgtgtcttgagaaacagtatatagaatctgatggggaacaaagggaaagatttctagagatcaagaaaagagctgcacaaaaagaaaacacattttcagtggggagctgtttccttccatgtggcgctgtgattattttagcctctggaaagaagctccctcactcctaccagggaagaaagaggggcttaagtcgcttggattgaatgtggaaagattctactgagcatgctcagctcagcctcgccctctttttcatggggggagctgtccatagggtcagaagtttcttccgcgtctctgtctcacctgagcagttcacttcctgccacaggaaaacctgtcccgcatcagcccttccagagattttgt

SEQ ID NO: 349436 - DNA, 748 bp, Homo sapiens
cataaagctagcacttatttcaagtacagtgggaagcctttgtggggagtggggaatatgcaagtttaatgatgtgatttacatttgtaatggatcagtggctactatttggaaattcagtcatgtatgggaaagtagaattcgagagccaaattagaaacagaccaaaggtgattttctttggggataaactaccagtagtctagacccgaatttaaaggtcttatattctatacctggctcattttattgtctgagaaaattccctgtaatctttgtttttcctcctctatgttgtgtttattttattttccatcacatttataacccctcagttaaatgatacgctaatgaaatctaaaactgtagtgtatgcttctagtctttcaagaccatttgtcaggtctgaatatttttttgctttgcatttttatatatactcattttttagaggtattgtgaaatgcttaaaactcaatttaaattctctccagtgtatgtgcttacatgtacttatgtgtggcttacccatgattataatttgcctaccactggaaataataaccaataatgtcgaaaattatttgagtaccctctgagtcacactgtagcaagtgctcatttaactgacacagcactctagcaaaataaatattttatgcccataagaaaacagacgttctgagagagaaagtaatttgtctaaggctacatagcttgttagtgaaaaatctgatttttaaacttg

SEQ ID NO: 349437 - DNA, 557 bp, Homo sapiens
aaaatttttttaatgctactattgttgtaatgagtcatattaagtgggattatacatgtaccaaacttttattttttcttgagtgagattatttcatggttattttaattggcatgccttacgattgagttaaattgattatatttgtcacttttttttgcaaactgcctaccagtaccctatttcgggtactttgcagcttcaaataagaaaaattttaattaaaaatgcattaaaccataaataaaatttacctcacatgactggaagtccaggtgtaattcagtggctcaattaaattatcacggacctagatggttttcattttcctgctgttttatactcagcttgttgtcgatagttgctaaattaattcacttaaataatcatttaccacctaaaatgtattaggcagtagtccataagcacgggaaatacagcagtgagcaaaacaaagttcattgccttccttcacgggcttatattttagtggggataagggagaagacagtcaaacaaataggtagaatttatagattgtcagaagatgttaagtt

SEQ ID NO: 349438 - DNA, 341 bp, Homo sapiens
  misc_feature (45)..(45): n is a, c, g, or t
ccttggctaaacaagataaggagtatgcagtgtggcaccactttngggagaaatcaaaaggttctggcttcagtgatcctctcactggagcaccatctcaatacttagagagactttccaaaatagccatattggaatatgataccattcgtcaggaaacaaccacaaaatcaaaaaaaagcaagaaacgagacctccgagaccgctgaaaaatgtcgtacagtgtgatgctttcttcagtgacttttaagctttatattttctttttttatatgatatgatgcaaaatgatttatataaaaatggaaatgtaaataaataaatattttacattataaaaa

SEQ ID NO: 349439 - DNA, 434 bp, Homo sapiens
gtgtggaaatggcctgtagcctgcaggagcctgaggagaagagaggagctagcagccccagtcaagtctagcgaagtgcatcttggcctgcagtgatggctgtttcccccagaaagttcttccacttctggatcccacctcgactgaaccttacacaatctactgctggactttccaatggcatgagttggtaaatcatctcatttttgcaaaagcaagtgtaacttgagtttccatcacttgcagctgagagaacacttgttcttgaattttatccacaatgaggtgctggatgttttctgtttgccccatgaactcactctctgccttccctgtcttgctgtctacccttactggttcttttttcctttctgctttggtttccagttggctctggccaatgatagaagacgataaaagagcgagggagaata

SEQ ID NO: 349440 - DNA, 1504 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349441 - DNA, 392 bp, Homo sapiens
cccccccccgcgcctaactaggctaggtacgaggcgggtgttaatcggccgaggccatgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349442 - DNA, 1269 bp, Homo sapiens
ctgctttcccctttttttctaggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349443 - DNA, 1298 bp, Homo sapiens
  misc_feature (28)..(28): n is a, c, g, or t
ctagtaatgagataacaaacaaacaaanttggaacaaaaaagccacatttggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349444 - DNA, 1289 bp, Homo sapiens
ttaggcgcgttctgcgtcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349445 - DNA, 1550 bp, Homo sapiens
  misc_feature (1506)..(1506): n is a, c, g, or t
  misc_feature (1513)..(1513): n is a, c, g, or t
  misc_feature (1520)..(1520): n is a, c, g, or t
  misc_feature (1522)..(1522): n is a, c, g, or t
  misc_feature (1524)..(1524): n is a, c, g, or t
  misc_feature (1530)..(1530): n is a, c, g, or t
  misc_feature (1532)..(1532): n is a, c, g, or t
  misc_feature (1536)..(1536): n is a, c, g, or t
  misc_feature (1542)..(1542): n is a, c, g, or t
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaaanacaaaanaaaaaancncnggagancnatancggggnggacaaaa

SEQ ID NO: 349446 - DNA, 1352 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccggatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349447 - DNA, 1625 bp, Homo sapiens
  misc_feature (375)..(375): n is a, c, g, or t
  misc_feature (382)..(382): n is a, c, g, or t
  misc_feature (384)..(384): n is a, c, g, or t
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccggtcactcctggaagcaaggcggtgtctatgtcataatattagtggtatgtggatgattagtacatcagcaagtccacttgcatgtggtcgagagactatcgtagacacagtaatgtacnagctatntntgcgtagagacatcagccaacgagagatctaaaatgggcgtagcgacctacgtagcgaaacctcttggaacatcatacatcatgctgatgaccaggaactcttgaataccaatagacacgctcctgggctgctcgctgcgtgaggtgcactggcatggggaaagggcaacgcgttctatttccagtgagcaacgtatgcatattctataccctcgtgaagccgccatgagcgaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349448 - DNA, 1072 bp, Homo sapiens
tgaggattcacgtagcatttcagcagcgacatgactacccagcagatagacctccaggccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349449 - DNA, 1469 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349450 - DNA, 1152 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349451 - DNA, 822 bp, Homo sapiens
tggggaccagagaggttaagttacttgcccaggatcacagagcagagtcactccagttcccatggccttgcttgaacatatatttatgagtggttctgaagagctgagtgatacttatgcaattctgcccttcctggccaatgacagtgttttcctcatttcaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349452 - DNA, 724 bp, Homo sapiens
aggcagtgatcgagctcggtacaggtgttgttggttttgcaggaaatcctggagttcaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349453 - DNA, 887 bp, Homo sapiens
tcctggaaaaatgcaacagagaggccagaaaggtcctgtgtcccagagccaggttgtgaaggttttccttcactgcggagcccttaggttatgaacatgtaaaatgagaaaaatcagggctgccctgttgaagtaggaggggtttttggaaaaatgtctctggaccctgggaaggagaagcaagtcccttatgattggaggccagttgggaggccctggtttcccctgtgatgggttcctggggagaagccccaggcccctgctcaggaaggatggtgccacctgctcaggtgccacctgcaggtgcttgtcactgatggagtcccttccctcccttgcttctgtagtggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349454 - DNA, 981 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgtgtgagtatctgcttccc

SEQ ID NO: 349455 - DNA, 1604 bp, Homo sapiens
tggggaccagagaggttaagttacttgcccaggatcacagagcagagtcactccagttcccatggccttgcttgaacatatatttatgagtggttctgaagagctgagtgatacttatgcaattctgcccttcctggccaatgacagtgttttcctcatttcaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaacaaccaaaaaaaaagggggcgggcggcgcaaccaccaggggccaaccaccccccggaaaacagcacccaccaccaaaacaagacgagcacctaaaacagcaaccaagacacccccgcagccgcacagtcacacaacacaaccaggcgaagacagcaacaaaagagcatgcccgcaaagcaacactagcaagaggcagaaagccaacccaccacggcggcggcggagacacaatcgccgccaacagctccacaacccgaacgaaagtaataacccgacccgacgacgagacaaacataacacacgacacagacaacaagcgaacgcacaacaaccaacaccacgtcacgacgagcaggccaacgagacaaccacaggacgacgagcaagaacccctaaagcacctgccaaccaaccccgacgcacagatccaaaagaaagagacatcaacaaacagaccagagacgagagaagagaaagcagaagaaaagcagacagagcacagcacgaaaagcggagaacggccaagaggaagcagaagagcaaggaaaaaaacacggaaaaggacaaacaaaaccagacgacgaagaccacagccgagaaacagccgaagagaagcgagacagacacgcggacaagcaaagaacaaaacaagaagaaggaaagaagcgcaggacgagag

SEQ ID NO: 349456 - DNA, 1617 bp, Homo sapiens
agctgctgaaaactgcatcagatactgaggtttaggacccaacttgtgtgtcctggtttggtgccttgaagaacctgttacctgtggttcagccataaggagacacccaggtgttcataagatcttcctcaactggatcccgagagtcaagggccttctccaaagggtggccagagccctgtgggcactgggagcctgggggtgttactgccaccttgatcctgcggacttggaattcccatccaggaaggtcttgtaatgtggaaaaaaaaagttgtgaacttaccctgggatgatgacagtaatatttttagtataccttagtttagaaaatctaaccagataccttggttagagatagtactctgaggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349457 - DNA, 1615 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaaaaaaaaatactccacaccctcacacctccagggggggcccagctcccaattttccctatagggagcctctttaactctcgcttactgccccccccctcgcgacaccccctg

SEQ ID NO: 349458 - DNA, 2286 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaacaaccaaaaaaaaagggggcgggcggcgcaaccaccaggggccaaccaccccccggaaaacagcacccaccaccaaaacaagacgagcacctaaaacagcaaccaagacacccccgcagccgcacagtcacacaacacaaccaggcgaagacagcaacaaaagagcatgcccgcaaagcaacactagcaagaggcagaaagccaacccaccacggcggcggcggagacacaatcgccgccaacagctccacaacccgaacgaaagtaataacccgacccgacgacgagacaaacataacacacgacacagacaacaagcgaacgcacaacaaccaacaccacgtcacgacgagcaggccaacgagacaaccacaggacgacgagcaagaacccctaaagcacctgccaaccaaccccgacgcacagatccaaaagaaagagacatcaacaaacagaccagagacgagagaagagaaagcagaagaaaagcagacagagcacagcacgaaaagcggagaacggccaagaggaagcagaagagcaaggaaaaaaacacggaaaaggacaaacaaaaccagacgacgaagaccacagccgagaaacagccgaagagaagcgagacagacacgcggacaagcaaagaacaaaacaagaagaaggaaagaagcgcaggacgagag

SEQ ID NO: 349459 - DNA, 1267 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349460 - DNA, 1457 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgcccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349461 - DNA, 1500 bp, Homo sapiens
  misc_feature (392)..(392): n is a, c, g, or t
  misc_feature (480)..(480): n is a, c, g, or t
  misc_feature (657)..(657): n is a, c, g, or t
ttaggcgcgttctgcgtcgagcagcctctcgccatttcccgggtcagtcctggatacgcaaggcggctctagctaatttatagtattggcaggactgtacatcgagcgaggccgattgagtgcgggcacacagatacataggctaactagtgagcagcactctgggaagcgtcaggaacagaatcatcaggctgcgacgagatctgacctgggacgtctctactgtagtgcatgatctgaacatagaatgtcgtggtctacctcgtggttgacggatgaagggaagcggtcatccattacgatagcatgaacttatgagacgcggtctgcagagcacgctcaagcgaaggagtctcttcgactaccatacgaggaaggcagccgcatcgaancgctgacagggtggtcgcttattgggccccttttctgatcgccgggccttttcgaccctaggccgtgcgcaagtcgactaatcgtagngccaagggaggtgctactccaacgataatcgccagttacaatacaaagctcgcgagtcctggggcgcatgcatacgttctatgcctggagaaatagtcaatctgcccggacactttacaaacgagagtgacgccgctggaaagatccacataggacgtgcgtgaccgaggtcgtggntggaaggtcggaacaggcgaggacccgttgagtcttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtgagccagcagatctgaccactgttctccagcaggcctctgctgcagctttttctctcagtgttctggccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349462 - DNA, 1431 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccctctcctctcttgaaagttctctgcttactttggttttccctctgcttgtaaaacattgagtcccctccctgccttggttaattgactcacaccagctgtgcgatgcccgcttttacaattaaaggaaaactgttgtgttcagtgtcaccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349463 - DNA, 1070 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgccttgtcagcaacactgtgtcccttcgccccgccgttcttctctgctgcatttggacatcagccaaatttgaacccaatcaaatataacgtgtctgacactgattttgtttttactcaataaatgtatagactacaaa

SEQ ID NO: 349464 - DNA, 870 bp, Homo sapiens
cccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaagaggtaatcagctccatctgcagtc

SEQ ID NO: 349465 - DNA, 479 bp, Homo sapiens
tcatcatcatcatcttcaatgacaacaacatcattatcactggaaaacactgtgccaatgcagtggcattggtaccaaggtaaaatacaaggaatttaaggacaaaaaaagaagacagaaacataaaaatattaatacagaaggaaataaatagtataagagagttacagagaatgctgtgaatgttttgggtgggaaaagattgtttcatgaatccagaaaggattaagtagaacttggtgaaggaagttgaactggggaaatgcaagagatagacagtctaagaacactgaatagtttagtcaaatagggaaagctcatgagttagattaactgaatggtgagtaaggaaatagtggggaaaactccttacctaatttcagctaatagagggccttcgatgctaaatgaaggaatctgcactttgttctattgacagtaatgaaagttagttatttgagatggagtctcgctcagcc

SEQ ID NO: 349466 - DNA, 733 bp, Homo sapiens
aggctggctgcggcctgggcgaggacagcgtcaccggcctgggactgtggggagggctgaccctgtgtttatcttccagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccaggtgagtggcacacaacaccgccccgccccacctctgctctgtctcagatggtcactagaggctgctgcttaccagcggctctgctgggcccagacaaccacccagcaaaccaaactcaaccctggatgaatctgtggcccaaacacgcagtggatcccacagtcggtgctaacaggcaggtggggaagctctcccagggcctccccttagtagagcttcgaggtgcagccaggggtggagcaggggaggaggggcctcggggtggggcttccgtgcagagctggagagtttctgctgtgcaggaggcgggggctctgaggaagcaggtctgtcctccacccgccctcccggggacattcgtaggcgtgcctcgagcacaggctcccgggtcaggagagtgggggtggctgcgagaaggccaggcaggtttctgctggcaaggctcccccacacctcttctgagcacccctttcccacttgttctgtctgtccaccggactgtcggtcaga

SEQ ID NO: 349467 - DNA, 6352 bp, Homo sapiens
  misc_feature (4403)..(4403): n is a, c, g, or t
  misc_feature (4980)..(4980): n is a, c, g, or t
  misc_feature (5518)..(5518): n is a, c, g, or t
  misc_feature (6073)..(6073): n is a, c, g, or t
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccgtggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacatataactggggaaaactatgatgctttcggtgctgggaatgcagtgaggtcccacgtgggcagagcttggctgggctgggcaactccgacacacgtctctgggggtgtggcggcgctctcagtcggcactgtggaaggaagggtgacctgtgctttctccctgtcactgtgactgcaaggacaggggggcagccttggggttcagtccaggccaaattcagtgtcctcaactgggcgtggtggctcatacctgtaatcccagcactttgggaggccgaggcaaacagatcacctgaggtcaggagttcgagaccagcctggtcaacatggtgaaaccccatctctactaaaaatacaaagattagctgggcgtggtggcaggcccctataataccagctactggggaggctgaggcaggaaaatcccttgacgggtgcctgtaatcccagctacttcagaggcggaggcaggagaattgcttgaacctaggaggcagaggttgcagtgagccaagatcacatgactgcattccagcctaggccacagtgcgagactgtctcaaacaaaacaaacaaaaacaaattattcaacgtcctccaggcctgcccccgcccgaggctgcacgggctccagctcagactgcacttttctgtgctggttcctagagtggaagagaaggccactcagtgttcccgggaaatgcactcaggccnctccctgcttcctgcctgcaagtctggagtcagccaggcagctgtcttcaggaaaaagcctggccaccgatgcgtgctggatgagagtagcacggtctgggctccacacagcccccaatttgggagtgcacctgaaggcagatgctgaatgaaaaaacagtcccagcttgcttgttctcagcactaaccggctgctccccaaaaccgcatctgccaggcacatgtaccagcctgcagtatgaggggaggccccggtacattcagcatgtttttctgggtcttctgcagccaggcctctggctgccgtccctgcctggtgcccctttgcccctttgccttccctgccttgaaggccactaggactggcctgtgattcacccgggcctgggtcactgtgaagcagccacgcccttgtgtggctgtcacctcgcttgccccacactccccagcagtggtgttggtggtcccctccaaaagccctggtctagaaaggctgaggccagggatggtgaggagggggtggaaatgcacggtcattaggcccccgccccaggagatctgcatgaccacagggggnttgtgacccccacacacagtcagactcggctgcccaagaggaggctggctcggtggcttcctggcccaggctggctaccagcaagtggcagcttcagacccgtgaactcaggaatgggaccttcagaggatctgtgtggtctgtcctgggtgacccctccagcaacatgaaagctcagggtaaggctgagtgactgccctgccccacccatcccaggccggggagccaacattgtctccactgtgctctcggccccacgctcttacccggagaagaggctgcaaggaagtcgctgtccctgtctccactggaagtgagtggtgcagcatctctttggcaggtggggggcatcagtagctggccagaggggtcctcgtcgctgagctcctggatcaggggtcttggggacttggtgtcttgttttcggatttccaagtccctcttagcttcttttttaaagatgtctgtgaagggcacccgagccgcctttgaggtgtctttagagactgcaaatatatttgacagagtgtctgtgggnaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctgctttttcacccaatgtcacaaagtattctgttgccacatccaagaaaggcccaagggaacacaggactctgaaagttaggcctgggggtggccactccctgggcacagctcatgtctatgcccttctctctgccctctgctcccccagccactggctattcctcaccctcctggtacctgagagggcgcacccctgagccctgggctctgcttggcatgcccctgaaccccgtttccttcacagactctctgggacttagctccttggacagcagcccctccacagtaactgtgtctgttttcgtttgctgctgagctcgtgcacagagatgatggctgatgcctccttctccctcagggtacgggtctggcacgtgtgggntcctggtaatgccagtaatggcctctgggtggagtagggtcacgtcactctgagagaattccccattgtgcctcacagactcacccctttctttcccctctcctgttttcatttccttcccctatattcagacagacattcataggatggacatagaaatacatcttaatgacagaaagtactttcaggtaactatgcactgtactcagctgttacaaaccagcaatagattttcaagtggttcatcataaaatcttaaagaaattgaacaagaacaaa

SEQ ID NO: 349468 - DNA, 6558 bp, Homo sapiens
  misc_feature (4609)..(4609): n is a, c, g, or t
  misc_feature (5186)..(5186): n is a, c, g, or t
  misc_feature (5724)..(5724): n is a, c, g, or t
  misc_feature (6279)..(6279): n is a, c, g, or t
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaagtaaggcccttatatacactttcctccctcactggctgacctgctacctgacccctggccctttccatccctcctcagctctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggtatcgccgcttcctgtgaaaccccccaccctaacgaactgaactccgccctgttgagcatgtcgcgacccttgagccccttccccatcagcctgtccccctgcccacggcttgcctgtctccccaaggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccgtggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacatataactggggaaaactatgatgctttcggtgctgggaatgcagtgaggtcccacgtgggcagagcttggctgggctgggcaactccgacacacgtctctgggggtgtggcggcgctctcagtcggcactgtggaaggaagggtgacctgtgctttctccctgtcactgtgactgcaaggacaggggggcagccttggggttcagtccaggccaaattcagtgtcctcaactgggcgtggtggctcatacctgtaatcccagcactttgggaggccgaggcaaacagatcacctgaggtcaggagttcgagaccagcctggtcaacatggtgaaaccccatctctactaaaaatacaaagattagctgggcgtggtggcaggcccctataataccagctactggggaggctgaggcaggaaaatcccttgacgggtgcctgtaatcccagctacttcagaggcggaggcaggagaattgcttgaacctaggaggcagaggttgcagtgagccaagatcacatgactgcattccagcctaggccacagtgcgagactgtctcaaacaaaacaaacaaaaacaaattattcaacgtcctccaggcctgcccccgcccgaggctgcacgggctccagctcagactgcacttttctgtgctggttcctagagtggaagagaaggccactcagtgttcccgggaaatgcactcaggccnctccctgcttcctgcctgcaagtctggagtcagccaggcagctgtcttcaggaaaaagcctggccaccgatgcgtgctggatgagagtagcacggtctgggctccacacagcccccaatttgggagtgcacctgaaggcagatgctgaatgaaaaaacagtcccagcttgcttgttctcagcactaaccggctgctccccaaaaccgcatctgccaggcacatgtaccagcctgcagtatgaggggaggccccggtacattcagcatgtttttctgggtcttctgcagccaggcctctggctgccgtccctgcctggtgcccctttgcccctttgccttccctgccttgaaggccactaggactggcctgtgattcacccgggcctgggtcactgtgaagcagccacgcccttgtgtggctgtcacctcgcttgccccacactccccagcagtggtgttggtggtcccctccaaaagccctggtctagaaaggctgaggccagggatggtgaggagggggtggaaatgcacggtcattaggcccccgccccaggagatctgcatgaccacagggggnttgtgacccccacacacagtcagactcggctgcccaagaggaggctggctcggtggcttcctggcccaggctggctaccagcaagtggcagcttcagacccgtgaactcaggaatgggaccttcagaggatctgtgtggtctgtcctgggtgacccctccagcaacatgaaagctcagggtaaggctgagtgactgccctgccccacccatcccaggccggggagccaacattgtctccactgtgctctcggccccacgctcttacccggagaagaggctgcaaggaagtcgctgtccctgtctccactggaagtgagtggtgcagcatctctttggcaggtggggggcatcagtagctggccagaggggtcctcgtcgctgagctcctggatcaggggtcttggggacttggtgtcttgttttcggatttccaagtccctcttagcttcttttttaaagatgtctgtgaagggcacccgagccgcctttgaggtgtctttagagactgcaaatatatttgacagagtgtctgtgggnaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctgctttttcacccaatgtcacaaagtattctgttgccacatccaagaaaggcccaagggaacacaggactctgaaagttaggcctgggggtggccactccctgggcacagctcatgtctatgcccttctctctgccctctgctcccccagccactggctattcctcaccctcctggtacctgagagggcgcacccctgagccctgggctctgcttggcatgcccctgaaccccgtttccttcacagactctctgggacttagctccttggacagcagcccctccacagtaactgtgtctgttttcgtttgctgctgagctcgtgcacagagatgatggctgatgcctccttctccctcagggtacgggtctggcacgtgtgggntcctggtaatgccagtaatggcctctgggtggagtagggtcacgtcactctgagagaattccccattgtgcctcacagactcacccctttctttcccctctcctgttttcatttccttcccctatattcagacagacattcataggatggacatagaaatacatcttaatgacagaaagtactttcaggtaactatgcactgtactcagctgttacaaaccagcaatagattttcaagtggttcatcataaaatcttaaagaaattgaacaagaacaaa

SEQ ID NO: 349469 - DNA, 6145 bp, Homo sapiens
  misc_feature (4196)..(4196): n is a, c, g, or t
  misc_feature (4773)..(4773): n is a, c, g, or t
  misc_feature (5311)..(5311): n is a, c, g, or t
  misc_feature (5866)..(5866): n is a, c, g, or t
tacttttggttcccccgagtatgggatatcgtcgaccgcgcctcgagctggagggagccgggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaagtaaggcccttatatacactttcctccctcactggctgacctgctacctgacccctggccctttccatccctcctcagctctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggtatcgccgcttcctgtgaaaccccccaccctaacgaactgaactccgccctgttgagcatgtcgcgacccttgagccccttccccatcagcctgtccccctgcccacggcttgcctgtctccccaaggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccgtggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacatataactggggaaaactatgatgctttcggtgctgggaatgcagtgaggtcccacgtgggcagagcttggctgggctgggcaactccgacacacgtctctgggggtgtggcggcgctctcagtcggcactgtggaaggaagggtgacctgtgctttctccctgtcactgtgactgcaaggacaggggggcagccttggggttcagtccaggccaaattcagtgtcctcaactgggcgtggtggctcatacctgtaatcccagcactttgggaggccgaggcaaacagatcacctgaggtcaggagttcgagaccagcctggtcaacatggtgaaaccccatctctactaaaaatacaaagattagctgggcgtggtggcaggcccctataataccagctactggggaggctgaggcaggaaaatcccttgacgggtgcctgtaatcccagctacttcagaggcggaggcaggagaattgcttgaacctaggaggcagaggttgcagtgagccaagatcacatgactgcattccagcctaggccacagtgcgagactgtctcaaacaaaacaaacaaaaacaaattattcaacgtcctccaggcctgcccccgcccgaggctgcacgggctccagctcagactgcacttttctgtgctggttcctagagtggaagagaaggccactcagtgttcccgggaaatgcactcaggccnctccctgcttcctgcctgcaagtctggagtcagccaggcagctgtcttcaggaaaaagcctggccaccgatgcgtgctggatgagagtagcacggtctgggctccacacagcccccaatttgggagtgcacctgaaggcagatgctgaatgaaaaaacagtcccagcttgcttgttctcagcactaaccggctgctccccaaaaccgcatctgccaggcacatgtaccagcctgcagtatgaggggaggccccggtacattcagcatgtttttctgggtcttctgcagccaggcctctggctgccgtccctgcctggtgcccctttgcccctttgccttccctgccttgaaggccactaggactggcctgtgattcacccgggcctgggtcactgtgaagcagccacgcccttgtgtggctgtcacctcgcttgccccacactccccagcagtggtgttggtggtcccctccaaaagccctggtctagaaaggctgaggccagggatggtgaggagggggtggaaatgcacggtcattaggcccccgccccaggagatctgcatgaccacagggggnttgtgacccccacacacagtcagactcggctgcccaagaggaggctggctcggtggcttcctggcccaggctggctaccagcaagtggcagcttcagacccgtgaactcaggaatgggaccttcagaggatctgtgtggtctgtcctgggtgacccctccagcaacatgaaagctcagggtaaggctgagtgactgccctgccccacccatcccaggccggggagccaacattgtctccactgtgctctcggccccacgctcttacccggagaagaggctgcaaggaagtcgctgtccctgtctccactggaagtgagtggtgcagcatctctttggcaggtggggggcatcagtagctggccagaggggtcctcgtcgctgagctcctggatcaggggtcttggggacttggtgtcttgttttcggatttccaagtccctcttagcttcttttttaaagatgtctgtgaagggcacccgagccgcctttgaggtgtctttagagactgcaaatatatttgacagagtgtctgtgggnaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctgctttttcacccaatgtcacaaagtattctgttgccacatccaagaaaggcccaagggaacacaggactctgaaagttaggcctgggggtggccactccctgggcacagctcatgtctatgcccttctctctgccctctgctcccccagccactggctattcctcaccctcctggtacctgagagggcgcacccctgagccctgggctctgcttggcatgcccctgaaccccgtttccttcacagactctctgggacttagctccttggacagcagcccctccacagtaactgtgtctgttttcgtttgctgctgagctcgtgcacagagatgatggctgatgcctccttctccctcagggtacgggtctggcacgtgtgggntcctggtaatgccagtaatggcctctgggtggagtagggtcacgtcactctgagagaattccccattgtgcctcacagactcacccctttctttcccctctcctgttttcatttccttcccctatattcagacagacattcataggatggacatagaaatacatcttaatgacagaaagtactttcaggtaactatgcactgtactcagctgttacaaaccagcaatagattttcaagtggttcatcataaaatcttaaagaaattgaacaagaacaaa

SEQ ID NO: 349470 - DNA, 6159 bp, Homo sapiens
  misc_feature (4210)..(4210): n is a, c, g, or t
  misc_feature (4787)..(4787): n is a, c, g, or t
  misc_feature (5325)..(5325): n is a, c, g, or t
  misc_feature (5880)..(5880): n is a, c, g, or t
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccgtggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacatataactggggaaaactatgatgctttcggtgctgggaatgcagtgaggtcccacgtgggcagagcttggctgggctgggcaactccgacacacgtctctgggggtgtggcggcgctctcagtcggcactgtggaaggaagggtgacctgtgctttctccctgtcactgtgactgcaaggacaggggggcagccttggggttcagtccaggccaaattcagtgtcctcaactgggcgtggtggctcatacctgtaatcccagcactttgggaggccgaggcaaacagatcacctgaggtcaggagttcgagaccagcctggtcaacatggtgaaaccccatctctactaaaaatacaaagattagctgggcgtggtggcaggcccctataataccagctactggggaggctgaggcaggaaaatcccttgacgggtgcctgtaatcccagctacttcagaggcggaggcaggagaattgcttgaacctaggaggcagaggttgcagtgagccaagatcacatgactgcattccagcctaggccacagtgcgagactgtctcaaacaaaacaaacaaaaacaaattattcaacgtcctccaggcctgcccccgcccgaggctgcacgggctccagctcagactgcacttttctgtgctggttcctagagtggaagagaaggccactcagtgttcccgggaaatgcactcaggccnctccctgcttcctgcctgcaagtctggagtcagccaggcagctgtcttcaggaaaaagcctggccaccgatgcgtgctggatgagagtagcacggtctgggctccacacagcccccaatttgggagtgcacctgaaggcagatgctgaatgaaaaaacagtcccagcttgcttgttctcagcactaaccggctgctccccaaaaccgcatctgccaggcacatgtaccagcctgcagtatgaggggaggccccggtacattcagcatgtttttctgggtcttctgcagccaggcctctggctgccgtccctgcctggtgcccctttgcccctttgccttccctgccttgaaggccactaggactggcctgtgattcacccgggcctgggtcactgtgaagcagccacgcccttgtgtggctgtcacctcgcttgccccacactccccagcagtggtgttggtggtcccctccaaaagccctggtctagaaaggctgaggccagggatggtgaggagggggtggaaatgcacggtcattaggcccccgccccaggagatctgcatgaccacagggggnttgtgacccccacacacagtcagactcggctgcccaagaggaggctggctcggtggcttcctggcccaggctggctaccagcaagtggcagcttcagacccgtgaactcaggaatgggaccttcagaggatctgtgtggtctgtcctgggtgacccctccagcaacatgaaagctcagggtaaggctgagtgactgccctgccccacccatcccaggccggggagccaacattgtctccactgtgctctcggccccacgctcttacccggagaagaggctgcaaggaagtcgctgtccctgtctccactggaagtgagtggtgcagcatctctttggcaggtggggggcatcagtagctggccagaggggtcctcgtcgctgagctcctggatcaggggtcttggggacttggtgtcttgttttcggatttccaagtccctcttagcttcttttttaaagatgtctgtgaagggcacccgagccgcctttgaggtgtctttagagactgcaaatatatttgacagagtgtctgtgggnaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctgctttttcacccaatgtcacaaagtattctgttgccacatccaagaaaggcccaagggaacacaggactctgaaagttaggcctgggggtggccactccctgggcacagctcatgtctatgcccttctctctgccctctgctcccccagccactggctattcctcaccctcctggtacctgagagggcgcacccctgagccctgggctctgcttggcatgcccctgaaccccgtttccttcacagactctctgggacttagctccttggacagcagcccctccacagtaactgtgtctgttttcgtttgctgctgagctcgtgcacagagatgatggctgatgcctccttctccctcagggtacgggtctggcacgtgtgggntcctggtaatgccagtaatggcctctgggtggagtagggtcacgtcactctgagagaattccccattgtgcctcacagactcacccctttctttcccctctcctgttttcatttccttcccctatattcagacagacattcataggatggacatagaaatacatcttaatgacagaaagtactttcaggtaactatgcactgtactcagctgttacaaaccagcaatagattttcaagtggttcatcataaaatcttaaagaaattgaacaagaacaaa

SEQ ID NO: 349471 - DNA, 4214 bp, Homo sapiens
  misc_feature (3380)..(3380): n is a, c, g, or t
  misc_feature (3935)..(3935): n is a, c, g, or t
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctaccggagaagaggctgcaaggaagtcgctgtccctgtctccactggaagtgagtggtgcagcatctctttggcaggtggggggcatcagtagctggccagaggggtcctcgtcgctgagctcctggatcaggggtcttggggacttggtgtcttgttttcggatttccaagtccctcttagcttcttttttaaagatgtctgtgaagggcacccgagccgcctttgaggtgtctttagagactgcaaatatatttgacagagtgtctgtgggnaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctgctttttcacccaatgtcacaaagtattctgttgccacatccaagaaaggcccaagggaacacaggactctgaaagttaggcctgggggtggccactccctgggcacagctcatgtctatgcccttctctctgccctctgctcccccagccactggctattcctcaccctcctggtacctgagagggcgcacccctgagccctgggctctgcttggcatgcccctgaaccccgtttccttcacagactctctgggacttagctccttggacagcagcccctccacagtaactgtgtctgttttcgtttgctgctgagctcgtgcacagagatgatggctgatgcctccttctccctcagggtacgggtctggcacgtgtgggntcctggtaatgccagtaatggcctctgggtggagtagggtcacgtcactctgagagaattccccattgtgcctcacagactcacccctttctttcccctctcctgttttcatttccttcccctatattcagacagacattcataggatggacatagaaatacatcttaatgacagaaagtactttcaggtaactatgcactgtactcagctgttacaaaccagcaatagattttcaagtggttcatcataaaatcttaaagaaattgaacaagaacaaa

SEQ ID NO: 349472 - DNA, 2828 bp, Homo sapiens
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtaggcgcagcgctcccctatactaccagacacggccccgcc

SEQ ID NO: 349473 - DNA, 1736 bp, Homo sapiens
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcgggaaatctacagggacccctgaagaccactcgatgtaccgggactccttctatcagtaggacggatagggggcaagacattcagatgagcaaccccatacgggatgctgaaccggatgcggattgaccagacaaccggagtgacaagaatgactggacaaacattcaagggccagcccgggctgatggctctgctgcatttaccgataaggagcggcaaaagcatccgaggcccaagacacggggaaacaagagacccaggctaaacccaagtaccctgggggggaaaatccagaacccaaaatgacaccacaccgtaagcttacaacaccggtcaggacccacgaagtcatatctaactagaagggcagaggcgataccgctggaggcaagaaaagtggaccgaggcacacataccgaagagaagaacgcaggggatcaagcgagacacaggagcaacccggaaggaaagacggggggaggaaagaggaagcgcaagaaagagaaacgcacaaacacgagaagccaagacagacagagaacagcgggaggaaggaaaagaagaacaaagagcacaagaagccggaaattgagataaacagacagagacacaaggacccgacgacgagagcgcga

SEQ ID NO: 349474 - DNA, 913 bp, Homo sapiens
ttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggtgagggtccaggccagggtgggcggcgtgtgggagatggggcggtcggggcctggacagggcctcagctgtctgtccttcctcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtgtgctgggtgggggagtgagcttggggggcgcagtggaaaacatcccctccccccgctaggccctggaggtcattgtcattcccgtcaccaggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaa

SEQ ID NO: 349475 - DNA, 291 bp, Homo sapiens
gagtgccaaagctggggttctacttgagatttccctcgtggtgccagggtccggcgagcatcacgccgaggcccattttccagacgaccacgacgaggccggggtcacgtaagtgcacgcatgcgccccctccgcgcggactgcgcgtgttcgaggagcggacccgcagatgtaggaggggagggacgcccccaatccccagtccccgcggcaggctcacgtttcgcagtccccggcctgtcgttattgcggatccgactgagttctgtagccttggaggtctaaagggtc

SEQ ID NO: 349476 - DNA, 3930 bp, Homo sapiens
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaagtaaggcccttatatacactttcctccctcactggctgacctgctacctgacccctggccctttccatccctcctcagctctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccgtggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacata

SEQ ID NO: 349477 - DNA, 6062 bp, Homo sapiens
  misc_feature (4113)..(4113): n is a, c, g, or t
  misc_feature (4690)..(4690): n is a, c, g, or t
  misc_feature (5228)..(5228): n is a, c, g, or t
  misc_feature (5783)..(5783): n is a, c, g, or t
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatctctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccgtggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacatataactggggaaaactatgatgctttcggtgctgggaatgcagtgaggtcccacgtgggcagagcttggctgggctgggcaactccgacacacgtctctgggggtgtggcggcgctctcagtcggcactgtggaaggaagggtgacctgtgctttctccctgtcactgtgactgcaaggacaggggggcagccttggggttcagtccaggccaaattcagtgtcctcaactgggcgtggtggctcatacctgtaatcccagcactttgggaggccgaggcaaacagatcacctgaggtcaggagttcgagaccagcctggtcaacatggtgaaaccccatctctactaaaaatacaaagattagctgggcgtggtggcaggcccctataataccagctactggggaggctgaggcaggaaaatcccttgacgggtgcctgtaatcccagctacttcagaggcggaggcaggagaattgcttgaacctaggaggcagaggttgcagtgagccaagatcacatgactgcattccagcctaggccacagtgcgagactgtctcaaacaaaacaaacaaaaacaaattattcaacgtcctccaggcctgcccccgcccgaggctgcacgggctccagctcagactgcacttttctgtgctggttcctagagtggaagagaaggccactcagtgttcccgggaaatgcactcaggccnctccctgcttcctgcctgcaagtctggagtcagccaggcagctgtcttcaggaaaaagcctggccaccgatgcgtgctggatgagagtagcacggtctgggctccacacagcccccaatttgggagtgcacctgaaggcagatgctgaatgaaaaaacagtcccagcttgcttgttctcagcactaaccggctgctccccaaaaccgcatctgccaggcacatgtaccagcctgcagtatgaggggaggccccggtacattcagcatgtttttctgggtcttctgcagccaggcctctggctgccgtccctgcctggtgcccctttgcccctttgccttccctgccttgaaggccactaggactggcctgtgattcacccgggcctgggtcactgtgaagcagccacgcccttgtgtggctgtcacctcgcttgccccacactccccagcagtggtgttggtggtcccctccaaaagccctggtctagaaaggctgaggccagggatggtgaggagggggtggaaatgcacggtcattaggcccccgccccaggagatctgcatgaccacagggggnttgtgacccccacacacagtcagactcggctgcccaagaggaggctggctcggtggcttcctggcccaggctggctaccagcaagtggcagcttcagacccgtgaactcaggaatgggaccttcagaggatctgtgtggtctgtcctgggtgacccctccagcaacatgaaagctcagggtaaggctgagtgactgccctgccccacccatcccaggccggggagccaacattgtctccactgtgctctcggccccacgctcttacccggagaagaggctgcaaggaagtcgctgtccctgtctccactggaagtgagtggtgcagcatctctttggcaggtggggggcatcagtagctggccagaggggtcctcgtcgctgagctcctggatcaggggtcttggggacttggtgtcttgttttcggatttccaagtccctcttagcttcttttttaaagatgtctgtgaagggcacccgagccgcctttgaggtgtctttagagactgcaaatatatttgacagagtgtctgtgggnaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctgctttttcacccaatgtcacaaagtattctgttgccacatccaagaaaggcccaagggaacacaggactctgaaagttaggcctgggggtggccactccctgggcacagctcatgtctatgcccttctctctgccctctgctcccccagccactggctattcctcaccctcctggtacctgagagggcgcacccctgagccctgggctctgcttggcatgcccctgaaccccgtttccttcacagactctctgggacttagctccttggacagcagcccctccacagtaactgtgtctgttttcgtttgctgctgagctcgtgcacagagatgatggctgatgcctccttctccctcagggtacgggtctggcacgtgtgggntcctggtaatgccagtaatggcctctgggtggagtagggtcacgtcactctgagagaattccccattgtgcctcacagactcacccctttctttcccctctcctgttttcatttccttcccctatattcagacagacattcataggatggacatagaaatacatcttaatgacagaaagtactttcaggtaactatgcactgtactcagctgttacaaaccagcaatagattttcaagtggttcatcataaaatcttaaagaaattgaacaagaacaaa

SEQ ID NO: 349478 - DNA, 6297 bp, Homo sapiens
  misc_feature (4348)..(4348): n is a, c, g, or t
  misc_feature (4925)..(4925): n is a, c, g, or t
  misc_feature (5463)..(5463): n is a, c, g, or t
  misc_feature (6018)..(6018): n is a, c, g, or t
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtggctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggtatcgccgcttcctgtgaaaccccccaccctaacgaactgaactccgccctgttgagcatgtcgcgacccttgagccccttccccatcagcctgtccccctgcccacggcttgcctgtctccccaaggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccgtggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacatataactggggaaaactatgatgctttcggtgctgggaatgcagtgaggtcccacgtgggcagagcttggctgggctgggcaactccgacacacgtctctgggggtgtggcggcgctctcagtcggcactgtggaaggaagggtgacctgtgctttctccctgtcactgtgactgcaaggacaggggggcagccttggggttcagtccaggccaaattcagtgtcctcaactgggcgtggtggctcatacctgtaatcccagcactttgggaggccgaggcaaacagatcacctgaggtcaggagttcgagaccagcctggtcaacatggtgaaaccccatctctactaaaaatacaaagattagctgggcgtggtggcaggcccctataataccagctactggggaggctgaggcaggaaaatcccttgacgggtgcctgtaatcccagctacttcagaggcggaggcaggagaattgcttgaacctaggaggcagaggttgcagtgagccaagatcacatgactgcattccagcctaggccacagtgcgagactgtctcaaacaaaacaaacaaaaacaaattattcaacgtcctccaggcctgcccccgcccgaggctgcacgggctccagctcagactgcacttttctgtgctggttcctagagtggaagagaaggccactcagtgttcccgggaaatgcactcaggccnctccctgcttcctgcctgcaagtctggagtcagccaggcagctgtcttcaggaaaaagcctggccaccgatgcgtgctggatgagagtagcacggtctgggctccacacagcccccaatttgggagtgcacctgaaggcagatgctgaatgaaaaaacagtcccagcttgcttgttctcagcactaaccggctgctccccaaaaccgcatctgccaggcacatgtaccagcctgcagtatgaggggaggccccggtacattcagcatgtttttctgggtcttctgcagccaggcctctggctgccgtccctgcctggtgcccctttgcccctttgccttccctgccttgaaggccactaggactggcctgtgattcacccgggcctgggtcactgtgaagcagccacgcccttgtgtggctgtcacctcgcttgccccacactccccagcagtggtgttggtggtcccctccaaaagccctggtctagaaaggctgaggccagggatggtgaggagggggtggaaatgcacggtcattaggcccccgccccaggagatctgcatgaccacagggggnttgtgacccccacacacagtcagactcggctgcccaagaggaggctggctcggtggcttcctggcccaggctggctaccagcaagtggcagcttcagacccgtgaactcaggaatgggaccttcagaggatctgtgtggtctgtcctgggtgacccctccagcaacatgaaagctcagggtaaggctgagtgactgccctgccccacccatcccaggccggggagccaacattgtctccactgtgctctcggccccacgctcttacccggagaagaggctgcaaggaagtcgctgtccctgtctccactggaagtgagtggtgcagcatctctttggcaggtggggggcatcagtagctggccagaggggtcctcgtcgctgagctcctggatcaggggtcttggggacttggtgtcttgttttcggatttccaagtccctcttagcttcttttttaaagatgtctgtgaagggcacccgagccgcctttgaggtgtctttagagactgcaaatatatttgacagagtgtctgtgggnaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctgctttttcacccaatgtcacaaagtattctgttgccacatccaagaaaggcccaagggaacacaggactctgaaagttaggcctgggggtggccactccctgggcacagctcatgtctatgcccttctctctgccctctgctcccccagccactggctattcctcaccctcctggtacctgagagggcgcacccctgagccctgggctctgcttggcatgcccctgaaccccgtttccttcacagactctctgggacttagctccttggacagcagcccctccacagtaactgtgtctgttttcgtttgctgctgagctcgtgcacagagatgatggctgatgcctccttctccctcagggtacgggtctggcacgtgtgggntcctggtaatgccagtaatggcctctgggtggagtagggtcacgtcactctgagagaattccccattgtgcctcacagactcacccctttctttcccctctcctgttttcatttccttcccctatattcagacagacattcataggatggacatagaaatacatcttaatgacagaaagtactttcaggtaactatgcactgtactcagctgttacaaaccagcaatagattttcaagtggttcatcataaaatcttaaagaaattgaacaagaacaaa

SEQ ID NO: 349479 - DNA, 5109 bp, Homo sapiens
  misc_feature (3160)..(3160): n is a, c, g, or t
  misc_feature (3737)..(3737): n is a, c, g, or t
  misc_feature (4275)..(4275): n is a, c, g, or t
  misc_feature (4830)..(4830): n is a, c, g, or t
ggcacgtggaggctgatgggagatgctgctgcccctcagggctctgcactcacctggagagccacatggggcctggagggccactacacagctcagctcccaagttcggccacatcccccttccttctcgggccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccgtggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacatataactggggaaaactatgatgctttcggtgctgggaatgcagtgaggtcccacgtgggcagagcttggctgggctgggcaactccgacacacgtctctgggggtgtggcggcgctctcagtcggcactgtggaaggaagggtgacctgtgctttctccctgtcactgtgactgcaaggacaggggggcagccttggggttcagtccaggccaaattcagtgtcctcaactgggcgtggtggctcatacctgtaatcccagcactttgggaggccgaggcaaacagatcacctgaggtcaggagttcgagaccagcctggtcaacatggtgaaaccccatctctactaaaaatacaaagattagctgggcgtggtggcaggcccctataataccagctactggggaggctgaggcaggaaaatcccttgacgggtgcctgtaatcccagctacttcagaggcggaggcaggagaattgcttgaacctaggaggcagaggttgcagtgagccaagatcacatgactgcattccagcctaggccacagtgcgagactgtctcaaacaaaacaaacaaaaacaaattattcaacgtcctccaggcctgcccccgcccgaggctgcacgggctccagctcagactgcacttttctgtgctggttcctagagtggaagagaaggccactcagtgttcccgggaaatgcactcaggccnctccctgcttcctgcctgcaagtctggagtcagccaggcagctgtcttcaggaaaaagcctggccaccgatgcgtgctggatgagagtagcacggtctgggctccacacagcccccaatttgggagtgcacctgaaggcagatgctgaatgaaaaaacagtcccagcttgcttgttctcagcactaaccggctgctccccaaaaccgcatctgccaggcacatgtaccagcctgcagtatgaggggaggccccggtacattcagcatgtttttctgggtcttctgcagccaggcctctggctgccgtccctgcctggtgcccctttgcccctttgccttccctgccttgaaggccactaggactggcctgtgattcacccgggcctgggtcactgtgaagcagccacgcccttgtgtggctgtcacctcgcttgccccacactccccagcagtggtgttggtggtcccctccaaaagccctggtctagaaaggctgaggccagggatggtgaggagggggtggaaatgcacggtcattaggcccccgccccaggagatctgcatgaccacagggggnttgtgacccccacacacagtcagactcggctgcccaagaggaggctggctcggtggcttcctggcccaggctggctaccagcaagtggcagcttcagacccgtgaactcaggaatgggaccttcagaggatctgtgtggtctgtcctgggtgacccctccagcaacatgaaagctcagggtaaggctgagtgactgccctgccccacccatcccaggccggggagccaacattgtctccactgtgctctcggccccacgctcttacccggagaagaggctgcaaggaagtcgctgtccctgtctccactggaagtgagtggtgcagcatctctttggcaggtggggggcatcagtagctggccagaggggtcctcgtcgctgagctcctggatcaggggtcttggggacttggtgtcttgttttcggatttccaagtccctcttagcttcttttttaaagatgtctgtgaagggcacccgagccgcctttgaggtgtctttagagactgcaaatatatttgacagagtgtctgtgggnaggttttccagcacagggagtgacgtgtagtccagttcagggtcactgtcatcactcaagctcgagatgacctcaatcttcggaaagcacatattctatttacagaagaaaaggtgtctgaaagtttctgttttcacaacagaatcgctctacaatgcaccatgccagttctgctttttcacccaatgtcacaaagtattctgttgccacatccaagaaaggcccaagggaacacaggactctgaaagttaggcctgggggtggccactccctgggcacagctcatgtctatgcccttctctctgccctctgctcccccagccactggctattcctcaccctcctggtacctgagagggcgcacccctgagccctgggctctgcttggcatgcccctgaaccccgtttccttcacagactctctgggacttagctccttggacagcagcccctccacagtaactgtgtctgttttcgtttgctgctgagctcgtgcacagagatgatggctgatgcctccttctccctcagggtacgggtctggcacgtgtgggntcctggtaatgccagtaatggcctctgggtggagtagggtcacgtcactctgagagaattccccattgtgcctcacagactcacccctttctttcccctctcctgttttcatttccttcccctatattcagacagacattcataggatggacatagaaatacatcttaatgacagaaagtactttcaggtaactatgcactgtactcagctgttacaaaccagcaatagattttcaagtggttcatcataaaatcttaaagaaattgaacaagaacaaa

SEQ ID NO: 349480 - DNA, 3755 bp, Homo sapiens
  misc_feature (3702)..(3702): n is a, c, g, or t
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagccccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccgtggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttataattaaaccatttatgctacataaaaaaaaaaantcgacgcgggccgcgaatttagtattagtaggcggccgctctaaaagaaccaa

SEQ ID NO: 349481 - DNA, 1885 bp, Homo sapiens
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccaggtgagtggcacacaacaccgccccgccccacctctgctctgtctcagatggtcactagaggctgctgcttaccagcggctctgctgggcccagacaaccacccagcaaaccaaactcaaccctggatgaatctgtggcccaaacacgcagtggatcccacagtcggtgctaacaggcaggtggggaagctctcccagggcctccccttagtagagcttcgaggtgcagccaggggtggagcaggggaggaggggcctcggggtggggcttccgtgcagagctggagagtttctgctgtgcaggaggcgggggctctgaggaagcaggtctgtcctccacccgccctcccggggacattcgtaggcgtgcctcgagcacaggctcccgggtcaggagagtgggggtggctgcgagaaggccaggcaggtttctgctggcaaggctcccccacacctcttctgagcacccctttcccacttgttctgtctgtccaccggactgtcggtcaga

SEQ ID NO: 349482 - DNA, 1260 bp, Homo sapiens
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtaccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcaggtacgggctggcggcagaggacccacccc

SEQ ID NO: 349483 - DNA, 433 bp, Homo sapiens
tctttcaaattccattcaggctacaactgacgaggaaggttctgtttctaatatagccacagaaataaaggatggagaaaaatctgggacagtgtcttctcagaaaaaaccagccttgaaggccacaagtgatgagaaagattctttttcgaatataaccagagaaaaaaaggatggagaaatatctaggacaggtatcagcaaacaggtgtccaaggtgatcaattcaggactcttccactgaagagatgtgaagttgtcttctcagaaaccaccagccttgaaggctacaagtgtcaaggaagattctgttttgaatatagccagagaaaaaaaggatggagaaaaatctaggacagtgtcttttgagcaaccaccaggcttgaaggctacaagagacgagaaagattctcttttgaatatagccagagga

SEQ ID NO: 349484 - DNA, 1070 bp, Homo sapiens
  misc_feature (9)..(9): n is a, c, g, or t
  misc_feature (17)..(17): n is a, c, g, or t
ctttatttnccttgttnctatttttctgaagatcatctgaaaaaataacattattagtcatctctcataattaaacctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagaggtgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccattgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaac

SEQ ID NO: 349485 - DNA, 953 bp, Homo sapiens
gccacaagtgatgaggaaagattctttttcgaatataaccagagaaaaaaaggatggagaaatatctaggacagtgtcttctcagaaaccaccagccttgaaggctgcaagtgacaagacagattctgctttgaatacagctacagaaataaaggatggactacaatgtgggacagtgtcttctcagaaacaacaagccttgaaggctacaactgacgaggaaggttctgtttctaatatagccacagaaataaaggatggagaaaaatctgggacagtgtcttctcagaaaaaaccagccttgaaggctacaagtgacaagaaagattctgttccgaatatggccacagaaacaaaggatgaacaaatatctgggacagtgtcttctcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacagtgtcttctcagagacgaccagccttgaagactacaggtgatgagaaagattctgtttcgaatatagccagagaaataaaggatggagaaaaatctgggacagtgtctcctcagaaacaatcggcccagaaggttatatttaaaaagaaagtttctcttttgaatattgccacaagaataacgggcggtgggaaatctggaacagagtatcctgagaatctgcgcaccttgaaggctacaattgaaaataaagattctgtgactcaccggggcttccaccatgttgggcttgctgttcctcagtgtctttactgcatggaaaacatcgacaacattttgccgtttcaccatttcaacaacgatgcctata

SEQ ID NO: 349486 - DNA, 1160 bp, Homo sapiens
tttttttttacaggacctatctgagtttataactgtcacctttttatcttggttcttcactatactttaagctaaaacaatagcagaggtgttgtcttatctgcagaccttactataatatcttccaccttgtaggcactcaatatgtacatacttgttcaacgtatgaatgaatacatgttaaaaatgcacagtcctttatatccaaaaatctactcatgtattttatctctactttgttttttcctggttacagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagaggtgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccattgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaac

SEQ ID NO: 349487 - DNA, 1908 bp, Homo sapiens
gccacaagtgatgaggaaagattctttttcgaatataaccagagaaaaaaaggatggagaaatatctaggacagtgtcttctcagaaaccaccagccttgaaggctgcaagtgacaagacagattctgctttgaatacagctacagaaataaaggatggactacaatgtgggacagtgtcttctcagaaacaacaagccttgaaggctacaactgacgaggaaggttctgtttctaatatagccacagaaataaaggatggagaaaaatctgggacagtgtcttctcagaaaaaaccagccttgaaggctacaagtgacaagaaagattctgttccgaatatggccacagaaacaaaggatgaacaaatatctgggacagtgtcttctcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacagtgtctcctcagaaacaatcggcccagaaggttatatttaaaaagaaagtttctcttttgaatattgccacaagaataacgggcggtgggaaatctggaacagagtatcctgagaatctgcccaccttgaaggctacaattgaaaataaaaattctgttctgaatacagccaccaaaatgaaggatgtacaaacatccacaccagcagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagaggtgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccattgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaac

SEQ ID NO: 349488 - DNA, 1679 bp, Homo sapiens
gccacaagtgatgaggaaagattctttttcgaatataaccagagaaaaaaaggatggagaaatatctaggacagtgtcttctcagaaaccaccagccttgaaggctgcaagtgacaagacagattctgctttgaatacagctacagaaataaaggatggactacaatgtgggacagtgtcttctcagaaacaacaagccttgaaggctacaactgacgaggaaggttctgtttctaatatagccacagaaataaaggatggagaaaaatctgggacagtgtcttctcagaaaaaaccagccttgaaggctacaagtgacaagaaagattctgttccgaatatggccacagaaacaaaggatgaacaaatatctgggacagtgtcttctcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacagtgtctcctcagaaacaatcggcccagaaggttatatttaaaaagaaagtttctcttttgaatattgccacaagaataacgggcggtgggaaatctggaacagagtatcctgagaatctgcccaccttgaaggctacaattgaaaataaaaattctgttctgaatacagccaccaaaatgaaggatgtacaaacatccacaccagcagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgaggtatgacctagttttaaataaatgtttgaactgtttgttttatattaaagacgtataaggagaagttttgtaattgcgaactttccttctaggatttaacagggaagaaagcttcttaatcttatggagtgtgaaattattggatataatatcacaagttcttaattgtgaatacttctctaataattaaatgcatattcttttaaatcatagttttaatggctgtatagaattttaccttttggaaatctcattatttaattgatgaattgaatttcaggttttaaaaagtttttgtaataatgctacaaggaacatcttttatatacacatagttttctacatttctaattatttacattggataaattcttctggttaaagtatagaaacttttttagatctgttttagatctgtgatcaatatttctaaattgttcttaaggatgttcatattaatt

SEQ ID NO: 349489 - DNA, 483 bp, Homo sapiens
aggtaggatttgaatctagacctctgagactcatcagtgctttttccattaaaccatcttcagcaggcagctttccataaaccttcctgcccttgccccatggcacacacacatacttggaaaaatatctcctctaactaggcatttataaccattcattcaaccttatggataaaaacatacctttgtttcttatttattgcagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349490 - DNA, 2771 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349491 - DNA, 2879 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccgatgcggacggtaaagccgtttgggttagagcggcgcgggtgtccagtccgcggaacggggagatcgttggcaccttcgcttttttaggggaacggggatagttcgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349492 - DNA, 3013 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccgatgcggacggtaaagccgtttgggttagagcggcgcgggtgtccagtccgcggaacggggagatcgttggcaccttcgcttttttaggggaacggggatagttcggtaaactgaattgagaagcggatccgagggaggttgaaagctgtcaagcccgtgtagctctcccgctaggaggcggcacgcgggggaataggggcgctggagtttccccagctctacctcatctttctccacagccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349493 - DNA, 2563 bp, Homo sapiens
agcgggccggaagtcgctcgacttctacttccggtccgttccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349494 - DNA, 2713 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349495 - DNA, 2547 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349496 - DNA, 2790 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccgatgcggacggtaaagccgtttgggttagagcggcgcgggtgtccagtccgcggaacggggagatcgttggcaccttcgcttttttaggggaacggggatagttcgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaagtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349497 - DNA, 2205 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaagtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349498 - DNA, 2431 bp, Homo sapiens
gaaataggatttccctgcttaagttcccctcgtgctttgctttatctaattgtagtaagcctcttttcaaagacagtgcatcccctctcagtactcaggaaacagtttctcaattcttaatagagtaactaagacctaaaatttgagaatctgacatatcagggtgtatatcctgtccttgcctgttagtggctatgtcgccttagacaaatacccctaacctatcagcctcggcttctccctctgtgaagtgggggtaataataaagcctacctcaaaaggtaattatgagagtggcatatataaaattcttagtacagcactagctgataatagaatgggcttcataaaaattacctattagtggtatttagcataatactggatatagtacacactccataaatggtagatacaattattaatattatttgcattcatcttctttgtgcagactacactgtgttgatcctcttaagtgtaacattcagcagcctgcccagctttaatttcactcacactagatcctctagaaagcaagtttgtgccattgctgcagggaccctggtagattacagtagatggcagttgacatagtgtaaatagtaagaagaagcaataacttccacagttcagcagcctgactacatgttggtctttcagtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaacagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349499 - DNA, 293 bp, Homo sapiens
ccttagaggcagaggaagagtgttgcagcccttccaaaggtaacgagagagtgttctggctgagtatcgacacatggctttgatcccagactctgaaactggaccacccgaagatagcagcctggcgctggagccggaagattggaaagctctacaacagcttgtgcccgggcactctctgcctcatcctgctgccaggaaccaagaggtaaggactagaaagggtatcccttcaggactctgtcccctggatttcagctgttcttagagaaaaagccttttgctgatattta

SEQ ID NO: 349500 - DNA, 358 bp, Homo sapiens
gtttacatgaaaatatgtatttatcaattaagtctctaacataattctgtgaggccattatctttagtttccttttacagaaaagaaaagaaacggaaaattttaggaaactgaaaaatgaagttattagtaatggcaacaacttgctagtatccaataggcctgaggattaaattgattttctaccactaacaccaactttccttggttaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctt

SEQ ID NO: 349501 - DNA, 359 bp, Homo sapiens
ttgtatttatttgagcatcaaatgctctgcaagcaattatatttttaccactttgttttcttcaagattgcagaactaaatctagaagcactagctaatcaccaagaaatacaagcagcaggccaagagcctaaaaacacagcagaagtacttcagcacccaaacacaaggtaatattttcagtttgaaacaagagcaaagacaaatggagtatctagtttcttatttaacaacacctgagaatgtttttatcctcttttgagtctattaaaaactatttaccaaaaaatgataacatctatcacaaaaaccacggaaaaaataccaccttctagccttaatatatagtatttaatttc

SEQ ID NO: 349502 - DNA, 2678 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349503 - DNA, 2682 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaagtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349504 - DNA, 2573 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagagatgaggatcaagtggacagagatatcaactgtctatgctgggccatttagcaaaaattgcaatctcagggctctgaagaggctgtttaaaagctttggcccagtccagtcaatgacttttgttcttgaaacccgtcaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349505 - DNA, 2590 bp, Homo sapiens
cgccgtcgggggcactggattcgggcgggctctccgccctggcctctccgaacctgatccctgatcattaaaatgggaatgagtgtaataccaccttcctgcaacaaggctgtcattggctgtcactgggatagtgagtcggccgagtgcggtggctcatgcctgtaattccagcactttgggaggccgaggcgggcggatcacgagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349506 - DNA, 2479 bp, Homo sapiens
gaaataggatttccctgcttaagttcccctcgtgctttgctttatctaattgtagtaagcctcttttcaaagacagtgcatcccctctcagtactcaggaaacagtttctcaattcttaatagagtaactaagacctaaaatttgagaatctgacatatcagggtgtatatcctgtccttgcctgttagtggctatgtcgccttagacaaatacccctaacctatcagcctcggcttctccctctgtgaagtgggggtaataataaagcctacctcaaaaggtaattatgagagtggcatatataaaattcttagtacagcactagctgataatagaatgggcttcataaaaattacctattagtggtatttagcataatactggatatagtacacactccataaatggtagatacaattattaatattatttgcattcatcttctttgtgcagactacactgtgttgatcctcttaagtgtaacattcagcagcctgcccagctttaatttcactcacactagatcctctagaaagcaagtttgtgccattgctgcagggaccctggtagattacagtagatggcagttgacatagtgtaaatagtaagaagaagcaataacttccacagttcagcagcctgactacatgttggtctttcagtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcataaaaaaaaaaag

SEQ ID NO: 349507 - DNA, 1142 bp, Homo sapiens
agcgggccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccgatgcggacggtaaagccgtttgggttagagcggcgcgggtgtccagtccgcggaacggggagatcgttggcaccttcgcttttttaggggaacggggatagttcggtaaactgaattgagaagcggatccgagggaggttgaaagctgtcaagcccgtgtagctctcccgctaggaggcggcacgcgggggaataggggcgctggagtttccccagctctacctcatctttctccacagccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaagggttggcttaggcttactctgatattgctaacaa

SEQ ID NO: 349508 - DNA, 352 bp, Homo sapiens
aggctggggggcaggagagagaaaaccagaaaggagagaaaaacggagagaggaaagaaagaaaaagagaaaacaagccaaaaagcatgtaagaacaagaaaacaaacagagctggcaacagcaaatcagagtgacaaaaagagaaggagaaggacataggaagatgaagataatagagttcggattcccagaacagtgactcattggttgtatgaaataacagaatgctgctatttagaaactgttccccaccctctttccttgtctaaattctgaactccttaactactaaaatggtgccctattcatttttcatctcatgcatggaaacactacctgactccatagtac

SEQ ID NO: 349509 - DNA, 682 bp, Homo sapiens
tctgaacacatccaaacatcagaaggaacaaactccggacacgcagcctttaagaattgtaacactcaccgcgagggtccgtggcttcattcttgaagtcagtgagacgaagaacccaccaattccggtaggagtaggaaatcacatcaccttcttttaatcagtctcaaatacctggccccttgtggaacctgcaagagccaggtttggcgaatgcaatgataagcaattgtctaatcactgccttgaaaaagagcagagcatttgagtatgctgtctcctcctctccctcacttcagttgggcccaacatgacagtcttaatggaagctcgggggtcaaaggctggtggcttacttcacgtatattgcagcatttcagtactgctctgcacgtgtgctcccccgcctgatgaggtaagtgttaaacagggatgatcacagcttcaagtaagcaatgggaattggatgttttatgtcctctggcgccatcttcagcagagaaatatataggtcacttttacttgtctggttttggtcttgaaatatgtactgaaacttgtgaaggagcagacctatattaggatagagtaaaagagggaaagacaaaaacctcttgggcttttcaggagacttggttcattctctgcttttcaagccatctcatggccacatgcctgcttt

SEQ ID NO: 349510 - DNA, 4993 bp, Homo sapiens
  misc_feature (2209)..(2209): n is a, c, g, or t
acttacaaactgataggcttttaattgagcgcctccgccgagcccgagatgaaagggaagcggcggtgaaaggcggcccgcctgccctccggcctcaatactgattagccatctcgacagtgaatagttcaaggcattttcaaacttttttcctcagctctttccccttccttctcctcctcccaccccctcctccaatatctgccttgcccactccttttttagagaaaacaaatcatttccattgtttgcaaataaaatccgcaggacatccacgccaactgctgctgggggttggaggctttaggcctggcgcagagtaattaatggcccccactcccgggcccgcgccggccttcgggggtttggcctcctgcgcgaggtgcgcaggctcggacgctggcgcctcccaaaagccccgggcgcgcaggcccccaggcgcccccatgcgctcggaccctcggagtggagttttgagaaaagcgaacgcacgctgaccacgacccgcacccacgcagcacagcgcagccccacgagcgtgtgtggccacaccgggggacgcaggagccactccacggcccccccaggcttcaggtgctgaggctgcctcccctgagccgccggcgtaataagctgctggaattagaggagagggggaagagctgagtctggaggctggggagggacgcccttggctgcgtcccccccggccctgtcgcaggccccagaatttcagtgcccgggcctcgcggggaggccgcggcgatagcggcccaaaggtgggctcgcggcgttaggagcactaccattggttgggtcgacacctagacggccgcgcactcagtaaccaggcacacatggacacacccgaaggataagagtgcttcacagacgcgctgccccgcagagacagcgtaggactgtcccgccctccgaaacgcgcacctgggacttgctccccggagaccagacaaccgcctccctcagcgtggggcctcgccacccgctcgccgactcacctccctcagatgtcgcacggacactacaaacccccttgaatgcaggtgtgctcttacacgctcacactgacaaacaccagccccaagcacacaccgcctcactcccctcttctctccaaatgagcttcagtcaagttaccatttcataaagtttaccaacccaaagaatcaagggataaaatccaaacgcagaaaaagaatgcctaggagcaaattctaaaactcaccccggaaagttctcggtacccgtgcggagtgggagacagagaaagaagccggggaggggagtcaggtgggggaggggagtgagatgggccaagaggagagggcgagcataccaagggcagttccagacccgacccccgcgcgcacccggctcagccccaggtgcgcgccggtcgaaaccgggtctccaggctcggcccccgccccccacgcgggcacagactggctcccgactcccagagctcccagccccaccatttatcaaaaggacttgacaacaaaagaagagccggggcggaaaagcggaggaggggagattcaaagtcttctaagtcgttccgaggaagggggtgtgtcctcctccccaccccctctaatttctgcgagttcctggaggagaccctcgaacccgctccggacgctatcagagccccgataactcacgcagcgccacaggcatgcatacacactgggcatccaggtccaggtacccggtggcacgcacagcgcctccccttttcttcccaaacaacccgagtgacggtgcaaatcgaggggaacgcggcagtcccgctccgcttccctggaagaacccgcgttcccacaggcagccgccccctccctctctcgctccttccctcggctctcctagcgcagctcattccgactcggcgttccaataaattcgagagagcagccccgagttaccctggctccccagcctgcggggatggcggcaggtgggagaaggtcggggagggggcatgagtgagcctgagatgtttcttcccccatacacccatggccaggcctcttcttcgcagcctcttagccctgcttacgacccgagggggtcaaagaattgaggcgaggtttgccccaccattgacctccaggactagaagttccttggtggtgtggctcttagaagtctccgagtttggggttagggaactacagagggnggcagcctgacctccgcacgcaacacgccccgcgaggactcgcggcggcggggtggggtggcgggaaatctcccgtgttagaagttgccgccgctggtctcgggtacccggagccgcgcccgaactccgcgaccccaacagaccgaggctcccagaggtggaagggcgtctctccgacaccgagagggcaggcgcacactccaggcctgcgcgcccctctcggcgccctgggcgcacctgcgcactttactctcgctattcattttcctgacaccgtgcgcctctttcattctttttcttagagcccccaccccacccccatcccaggaggccgctcctcttttcccctcctccagttccctctcaatctcctccttcctctccgtctctctctccctctctctttttcccttcaagtcgcacccgccttgtaatcagcaacaaaagctgacataaatcacgggaggattgacaagagctgacaaataactgattgattgcggtcgaggaacattgacaattgatggaggggtggagatgcccaaagaagggggggagggaggaaaacagggtgggagagtaagaatggggggttgggggacagactgagggtgaaacagaggaaacatgtgacccccgctgctgccccaatctacgcgtccccgggcgtcacgtggccgggaagggcggagagcccagcgctcctcgcggtgttgagccgccgccgctgcgactgcccatctagcttctggtttctccgccgcggaatctgaggaaattagagcgggcgggcgggcttcttccagctccggctccccaccttgccttcttaccctggtggctgcgctgcgccgcgcgggatctcgattactgcgaaggaaaaaacactgggtgtgcaggttcccttcgcccctggagttgacagtccggccggtgtccacactcccaccggtgctccttctggacaccccccgcagtctgttcctcacgcgcaccccccttcaaaagaaggtttcagtttattttcgagctggggaaaggaagaacgacgaggaggaaaaaagagggaggcggcggatggcaaacgtagaataaatgtccatctcgtcctcccagcgaaatcgagggaggggacacacaggggggcggcgaagagggagctgcccattaaaaccggcactgagagtcctggcagcggcggcggcggcggcgcgggacgcgtcacatccccttgaccctccaatcacctcgggctcccatttgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgcccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatag

SEQ ID NO: 349511 - DNA, 4305 bp, Homo sapiens
  misc_feature (2209)..(2209): n is a, c, g, or t
acttacaaactgataggcttttaattgagcgcctccgccgagcccgagatgaaagggaagcggcggtgaaaggcggcccgcctgccctccggcctcaatactgattagccatctcgacagtgaatagttcaaggcattttcaaacttttttcctcagctctttccccttccttctcctcctcccaccccctcctccaatatctgccttgcccactccttttttagagaaaacaaatcatttccattgtttgcaaataaaatccgcaggacatccacgccaactgctgctgggggttggaggctttaggcctggcgcagagtaattaatggcccccactcccgggcccgcgccggccttcgggggtttggcctcctgcgcgaggtgcgcaggctcggacgctggcgcctcccaaaagccccgggcgcgcaggcccccaggcgcccccatgcgctcggaccctcggagtggagttttgagaaaagcgaacgcacgctgaccacgacccgcacccacgcagcacagcgcagccccacgagcgtgtgtggccacaccgggggacgcaggagccactccacggcccccccaggcttcaggtgctgaggctgcctcccctgagccgccggcgtaataagctgctggaattagaggagagggggaagagctgagtctggaggctggggagggacgcccttggctgcgtcccccccggccctgtcgcaggccccagaatttcagtgcccgggcctcgcggggaggccgcggcgatagcggcccaaaggtgggctcgcggcgttaggagcactaccattggttgggtcgacacctagacggccgcgcactcagtaaccaggcacacatggacacacccgaaggataagagtgcttcacagacgcgctgccccgcagagacagcgtaggactgtcccgccctccgaaacgcgcacctgggacttgctccccggagaccagacaaccgcctccctcagcgtggggcctcgccacccgctcgccgactcacctccctcagatgtcgcacggacactacaaacccccttgaatgcaggtgtgctcttacacgctcacactgacaaacaccagccccaagcacacaccgcctcactcccctcttctctccaaatgagcttcagtcaagttaccatttcataaagtttaccaacccaaagaatcaagggataaaatccaaacgcagaaaaagaatgcctaggagcaaattctaaaactcaccccggaaagttctcggtacccgtgcggagtgggagacagagaaagaagccggggaggggagtcaggtgggggaggggagtgagatgggccaagaggagagggcgagcataccaagggcagttccagacccgacccccgcgcgcacccggctcagccccaggtgcgcgccggtcgaaaccgggtctccaggctcggcccccgccccccacgcgggcacagactggctcccgactcccagagctcccagccccaccatttatcaaaaggacttgacaacaaaagaagagccggggcggaaaagcggaggaggggagattcaaagtcttctaagtcgttccgaggaagggggtgtgtcctcctccccaccccctctaatttctgcgagttcctggaggagaccctcgaacccgctccggacgctatcagagccccgataactcacgcagcgccacaggcatgcatacacactgggcatccaggtccaggtacccggtggcacgcacagcgcctccccttttcttcccaaacaacccgagtgacggtgcaaatcgaggggaacgcggcagtcccgctccgcttccctggaagaacccgcgttcccacaggcagccgccccctccctctctcgctccttccctcggctctcctagcgcagctcattccgactcggcgttccaataaattcgagagagcagccccgagttaccctggctccccagcctgcggggatggcggcaggtgggagaaggtcggggagggggcatgagtgagcctgagatgtttcttcccccatacacccatggccaggcctcttcttcgcagcctcttagccctgcttacgacccgagggggtcaaagaattgaggcgaggtttgccccaccattgacctccaggactagaagttccttggtggtgtggctcttagaagtctccgagtttggggttagggaactacagagggnggcagcctgacctccgcacgcaacacgccccgcgaggactcgcggcggcggggtggggtggcgggaaatctcccgtgttagaagttgccgccgctggtctcgggtacccggagccgcgcccgaactccgcgaccccaacagaccgaggctcccagaggtggaagggcgtctctccgacaccgagagggcaggcgcacactccaggcctgcgcgcccctctcggcgccctgggcgcacctgcgcactttactctcgctattcattttcctgacaccgtgcgcctctttcattctttttcttagagcccccaccccacccccatcccaggaggccgctcctcttttcccctcctccagttccctctcaatctcctccttcctctccgtctctctctccctctctctttttcccttcaagtcgcacccgccttgtaatcagcaacaaaagctgacataaatcacgggaggattgacaagagctgacaaataactgattgattgcggtcgaggaacattgacaattgatggaggggtggagatgcccaaagaagggggggagggaggaaaacagggtgggagagtaagaatggggggttgggggacagactgagggtgaaacagaggaaacatgtgacccccgctgctgccccaatctacgcgtccccgggcgtcacgtggccgggaagggcggagagcccagcgctcctcgcggtgttgagccgccgccgctgcgactgcccatctagcttctggtttctccgccgcggaatctgaggaaattagagcgggcgggcgggcttcttccagctccggctccccaccttgccttcttaccctggtggctgcgctgcgccgcgcgggatctcgattactgcgaaggaaaaaacactgggtgtgcaggttcccttcgcccctggagttgacagtccggccggtgtccacactcccaccggtgctccttctggacaccccccgcagtctgttcctcacgcgcaccccccttcaaaagaaggtttcagtttattttcgagctggggaaaggaagaacgacgaggaggaaaaaagagggaggcggcggatggcaaacgtagaataaatgtccatctcgtcctcccagcgaaatcgagggaggggacacacaggggggcggcgaagagggagctgcccattaaaaccggcactgagagtcctggcagcggcggcggcggcggcgcgggacgcgtcacatccccttgaccctccaatcacctcgggctcccatttgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgaggtaaggaccctctctctggatcgcactgggaccactaccctggctgccaccctagggctttctttttctcgggatctgggcggaggtgggggggtcggagtgattc

SEQ ID NO: 349512 - DNA, 7559 bp, Homo sapiens
  misc_feature (2209)..(2209): n is a, c, g, or t
  misc_feature (6739)..(6739): n is a, c, g, or t
  misc_feature (6746)..(6746): n is a, c, g, or t
acttacaaactgataggcttttaattgagcgcctccgccgagcccgagatgaaagggaagcggcggtgaaaggcggcccgcctgccctccggcctcaatactgattagccatctcgacagtgaatagttcaaggcattttcaaacttttttcctcagctctttccccttccttctcctcctcccaccccctcctccaatatctgccttgcccactccttttttagagaaaacaaatcatttccattgtttgcaaataaaatccgcaggacatccacgccaactgctgctgggggttggaggctttaggcctggcgcagagtaattaatggcccccactcccgggcccgcgccggccttcgggggtttggcctcctgcgcgaggtgcgcaggctcggacgctggcgcctcccaaaagccccgggcgcgcaggcccccaggcgcccccatgcgctcggaccctcggagtggagttttgagaaaagcgaacgcacgctgaccacgacccgcacccacgcagcacagcgcagccccacgagcgtgtgtggccacaccgggggacgcaggagccactccacggcccccccaggcttcaggtgctgaggctgcctcccctgagccgccggcgtaataagctgctggaattagaggagagggggaagagctgagtctggaggctggggagggacgcccttggctgcgtcccccccggccctgtcgcaggccccagaatttcagtgcccgggcctcgcggggaggccgcggcgatagcggcccaaaggtgggctcgcggcgttaggagcactaccattggttgggtcgacacctagacggccgcgcactcagtaaccaggcacacatggacacacccgaaggataagagtgcttcacagacgcgctgccccgcagagacagcgtaggactgtcccgccctccgaaacgcgcacctgggacttgctccccggagaccagacaaccgcctccctcagcgtggggcctcgccacccgctcgccgactcacctccctcagatgtcgcacggacactacaaacccccttgaatgcaggtgtgctcttacacgctcacactgacaaacaccagccccaagcacacaccgcctcactcccctcttctctccaaatgagcttcagtcaagttaccatttcataaagtttaccaacccaaagaatcaagggataaaatccaaacgcagaaaaagaatgcctaggagcaaattctaaaactcaccccggaaagttctcggtacccgtgcggagtgggagacagagaaagaagccggggaggggagtcaggtgggggaggggagtgagatgggccaagaggagagggcgagcataccaagggcagttccagacccgacccccgcgcgcacccggctcagccccaggtgcgcgccggtcgaaaccgggtctccaggctcggcccccgccccccacgcgggcacagactggctcccgactcccagagctcccagccccaccatttatcaaaaggacttgacaacaaaagaagagccggggcggaaaagcggaggaggggagattcaaagtcttctaagtcgttccgaggaagggggtgtgtcctcctccccaccccctctaatttctgcgagttcctggaggagaccctcgaacccgctccggacgctatcagagccccgataactcacgcagcgccacaggcatgcatacacactgggcatccaggtccaggtacccggtggcacgcacagcgcctccccttttcttcccaaacaacccgagtgacggtgcaaatcgaggggaacgcggcagtcccgctccgcttccctggaagaacccgcgttcccacaggcagccgccccctccctctctcgctccttccctcggctctcctagcgcagctcattccgactcggcgttccaataaattcgagagagcagccccgagttaccctggctccccagcctgcggggatggcggcaggtgggagaaggtcggggagggggcatgagtgagcctgagatgtttcttcccccatacacccatggccaggcctcttcttcgcagcctcttagccctgcttacgacccgagggggtcaaagaattgaggcgaggtttgccccaccattgacctccaggactagaagttccttggtggtgtggctcttagaagtctccgagtttggggttagggaactacagagggnggcagcctgacctccgcacgcaacacgccccgcgaggactcgcggcggcggggtggggtggcgggaaatctcccgtgttagaagttgccgccgctggtctcgggtacccggagccgcgcccgaactccgcgaccccaacagaccgaggctcccagaggtggaagggcgtctctccgacaccgagagggcaggcgcacactccaggcctgcgcgcccctctcggcgccctgggcgcacctgcgcactttactctcgctattcattttcctgacaccgtgcgcctctttcattctttttcttagagcccccaccccacccccatcccaggaggccgctcctcttttcccctcctccagttccctctcaatctcctccttcctctccgtctctctctccctctctctttttcccttcaagtcgcacccgccttgtaatcagcaacaaaagctgacataaatcacgggaggattgacaagagctgacaaataactgattgattgcggtcgaggaacattgacaattgatggaggggtggagatgcccaaagaagggggggagggaggaaaacagggtgggagagtaagaatggggggttgggggacagactgagggtgaaacagaggaaacatgtgacccccgctgctgccccaatctacgcgtccccgggcgtcacgtggccgggaagggcggagagcccagcgctcctcgcggtgttgagccgccgccgctgcgactgcccatctagcttctggtttctccgccgcggaatctgaggaaattagagcgggcgggcgggcttcttccagctccggctccccaccttgccttcttaccctggtggctgcgctgcgccgcgcgggatctcgattactgcgaaggaaaaaacactgggtgtgcaggttcccttcgcccctggagttgacagtccggccggtgtccacactcccaccggtgctccttctggacaccccccgcagtctgttcctcacgcgcaccccccttcaaaagaaggtttcagtttattttcgagctggggaaaggaagaacgacgaggaggaaaaaagagggaggcggcggatggcaaacgtagaataaatgtccatctcgtcctcccagcgaaatcgagggaggggacacacaggggggcggcgaagagggagctgcccattaaaaccggcactgagagtcctggcagcggcggcggcggcggcgcgggacgcgtcacatccccttgaccctccaatcacctcgggctcccatttgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggcctgctcgccgggaggtatgctgtcctcggccgggggtgccccggagggcaaggacgacaagaaagacaccgacgtgggcggcggtggcaagggcaccgggggcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtacgttatttaatgtctgattgaaacacaaatttacatgcatgtttgttacaaaaaaaatgaaaaaaaaagtcacaatttgtcagctctgatttcaaattgcaattatttttaaggtgtataccatcgaagagaatgggtatttttttgtatgtattctggaagaaaacaacaaaaaaaaaaagaaaaagaaaaaattctattccaaaacctcatttgccttattttgttctttaaaaggaacacttaactatttttaatttttaagtccacccgctgagaaggggacaaggtttacgtcatgtactaaaataatagacaatgtatcgctttaaagattaaaattccgtatatttgatgtaaaaaaaaaaaaaanaaaaaanaaaaaaaaaaaaaaaaaaaaaaaaaaaaaaaaaaaaaaaaaaaaaaagaagaaaaaaaaaaaaaaaacaaaaaaaaggaaaaacaaaaaaaaaacaaaaagaaaaacaagaacaaagacgaacaataaaaaaaagagaagaacaggaaaggcacacaaaagaactaaccacgaacgaacaacagaacaagaggagaggaacaaaacagcggacacaaagcaggagcacaacagtcggagacaagaggcacagcaccaatagcctcgggaaggcagcgagcgacgcaacgcacagacgtggagtgaagcgaacgaaccgcacacaagagaagagacagaaacaacaacacacacacacgccacgatgggtagagaagaaaacagagtagagcgaacgagaccgaaagacgaagagaggagagcgaaaatccagtagaggggagacaaacaaaaggaggaggagagagcaaacgaagaggcgagcgacagaaggcgcgacaaaagaaagaacagagcaacgacagcgcgccgcaacacgcaggagggagagacggcacaagatgacgtacggacgaaggggagaagagacaagatcatagtccataaggacgaacggcggcaggagcaagcgcgcaaggaacaaggagaaagagaagagcggcacagcgtggagcccagggagcggagcggcccagacagcggagaacgaacgacagaagcacgaagcagcagagagagcggaggagcagagaagaagtagaggagaagaggacgagcaagaacgatgcagccaggggcaggggccggcgggggg

SEQ ID NO: 349513 - DNA, 6725 bp, Homo sapiens
  misc_feature (2209)..(2209): n is a, c, g, or t
acttacaaactgataggcttttaattgagcgcctccgccgagcccgagatgaaagggaagcggcggtgaaaggcggcccgcctgccctccggcctcaatactgattagccatctcgacagtgaatagttcaaggcattttcaaacttttttcctcagctctttccccttccttctcctcctcccaccccctcctccaatatctgccttgcccactccttttttagagaaaacaaatcatttccattgtttgcaaataaaatccgcaggacatccacgccaactgctgctgggggttggaggctttaggcctggcgcagagtaattaatggcccccactcccgggcccgcgccggccttcgggggtttggcctcctgcgcgaggtgcgcaggctcggacgctggcgcctcccaaaagccccgggcgcgcaggcccccaggcgcccccatgcgctcggaccctcggagtggagttttgagaaaagcgaacgcacgctgaccacgacccgcacccacgcagcacagcgcagccccacgagcgtgtgtggccacaccgggggacgcaggagccactccacggcccccccaggcttcaggtgctgaggctgcctcccctgagccgccggcgtaataagctgctggaattagaggagagggggaagagctgagtctggaggctggggagggacgcccttggctgcgtcccccccggccctgtcgcaggccccagaatttcagtgcccgggcctcgcggggaggccgcggcgatagcggcccaaaggtgggctcgcggcgttaggagcactaccattggttgggtcgacacctagacggccgcgcactcagtaaccaggcacacatggacacacccgaaggataagagtgcttcacagacgcgctgccccgcagagacagcgtaggactgtcccgccctccgaaacgcgcacctgggacttgctccccggagaccagacaaccgcctccctcagcgtggggcctcgccacccgctcgccgactcacctccctcagatgtcgcacggacactacaaacccccttgaatgcaggtgtgctcttacacgctcacactgacaaacaccagccccaagcacacaccgcctcactcccctcttctctccaaatgagcttcagtcaagttaccatttcataaagtttaccaacccaaagaatcaagggataaaatccaaacgcagaaaaagaatgcctaggagcaaattctaaaactcaccccggaaagttctcggtacccgtgcggagtgggagacagagaaagaagccggggaggggagtcaggtgggggaggggagtgagatgggccaagaggagagggcgagcataccaagggcagttccagacccgacccccgcgcgcacccggctcagccccaggtgcgcgccggtcgaaaccgggtctccaggctcggcccccgccccccacgcgggcacagactggctcccgactcccagagctcccagccccaccatttatcaaaaggacttgacaacaaaagaagagccggggcggaaaagcggaggaggggagattcaaagtcttctaagtcgttccgaggaagggggtgtgtcctcctccccaccccctctaatttctgcgagttcctggaggagaccctcgaacccgctccggacgctatcagagccccgataactcacgcagcgccacaggcatgcatacacactgggcatccaggtccaggtacccggtggcacgcacagcgcctccccttttcttcccaaacaacccgagtgacggtgcaaatcgaggggaacgcggcagtcccgctccgcttccctggaagaacccgcgttcccacaggcagccgccccctccctctctcgctccttccctcggctctcctagcgcagctcattccgactcggcgttccaataaattcgagagagcagccccgagttaccctggctccccagcctgcggggatggcggcaggtgggagaaggtcggggagggggcatgagtgagcctgagatgtttcttcccccatacacccatggccaggcctcttcttcgcagcctcttagccctgcttacgacccgagggggtcaaagaattgaggcgaggtttgccccaccattgacctccaggactagaagttccttggtggtgtggctcttagaagtctccgagtttggggttagggaactacagagggnggcagcctgacctccgcacgcaacacgccccgcgaggactcgcggcggcggggtggggtggcgggaaatctcccgtgttagaagttgccgccgctggtctcgggtacccggagccgcgcccgaactccgcgaccccaacagaccgaggctcccagaggtggaagggcgtctctccgacaccgagagggcaggcgcacactccaggcctgcgcgcccctctcggcgccctgggcgcacctgcgcactttactctcgctattcattttcctgacaccgtgcgcctctttcattctttttcttagagcccccaccccacccccatcccaggaggccgctcctcttttcccctcctccagttccctctcaatctcctccttcctctccgtctctctctccctctctctttttcccttcaagtcgcacccgccttgtaatcagcaacaaaagctgacataaatcacgggaggattgacaagagctgacaaataactgattgattgcggtcgaggaacattgacaattgatggaggggtggagatgcccaaagaagggggggagggaggaaaacagggtgggagagtaagaatggggggttgggggacagactgagggtgaaacagaggaaacatgtgacccccgctgctgccccaatctacgcgtccccgggcgtcacgtggccgggaagggcggagagcccagcgctcctcgcggtgttgagccgccgccgctgcgactgcccatctagcttctggtttctccgccgcggaatctgaggaaattagagcgggcgggcgggcttcttccagctccggctccccaccttgccttcttaccctggtggctgcgctgcgccgcgcgggatctcgattactgcgaaggaaaaaacactgggtgtgcaggttcccttcgcccctggagttgacagtccggccggtgtccacactcccaccggtgctccttctggacaccccccgcagtctgttcctcacgcgcaccccccttcaaaagaaggtttcagtttattttcgagctggggaaaggaagaacgacgaggaggaaaaaagagggaggcggcggatggcaaacgtagaataaatgtccatctcgtcctcccagcgaaatcgagggaggggacacacaggggggcggcgaagagggagctgcccattaaaaccggcactgagagtcctggcagcggcggcggcggcggcgcgggacgcgtcacatccccttgaccctccaatcacctcgggctcccatttgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggcctgctcgccgggaggtatgctgtcctcggccgggggtgccccggagggcaaggacgacaagaaagacaccgacgtgggcggcggtggcaagggcaccgggggcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtacgttatttaatgtctgattgaaacacaaatttacatgcatgtttgttacaaaaaaaatgaaaaaaaaagtcacaatttgtcagctctgatttcaaattgcaattatttttaaggtgtataccatcgaagagaatgggtatttttttgtatgtattctggaagaaaacaacaaaaaaaaaaagaaaaagaaaaaattctattccaaaacctcatttgccttattttgttctttaaaaggaacacttaactatttttaatttttaagtccacccgctgagaaggggacaaggtttacgtcatgtactaaaataatagacaatgtatcgctttaaagattaaaattccgtatatttgatgta

SEQ ID NO: 349514 - DNA, 6081 bp, Homo sapiens
  misc_feature (2209)..(2209): n is a, c, g, or t
acttacaaactgataggcttttaattgagcgcctccgccgagcccgagatgaaagggaagcggcggtgaaaggcggcccgcctgccctccggcctcaatactgattagccatctcgacagtgaatagttcaaggcattttcaaacttttttcctcagctctttccccttccttctcctcctcccaccccctcctccaatatctgccttgcccactccttttttagagaaaacaaatcatttccattgtttgcaaataaaatccgcaggacatccacgccaactgctgctgggggttggaggctttaggcctggcgcagagtaattaatggcccccactcccgggcccgcgccggccttcgggggtttggcctcctgcgcgaggtgcgcaggctcggacgctggcgcctcccaaaagccccgggcgcgcaggcccccaggcgcccccatgcgctcggaccctcggagtggagttttgagaaaagcgaacgcacgctgaccacgacccgcacccacgcagcacagcgcagccccacgagcgtgtgtggccacaccgggggacgcaggagccactccacggcccccccaggcttcaggtgctgaggctgcctcccctgagccgccggcgtaataagctgctggaattagaggagagggggaagagctgagtctggaggctggggagggacgcccttggctgcgtcccccccggccctgtcgcaggccccagaatttcagtgcccgggcctcgcggggaggccgcggcgatagcggcccaaaggtgggctcgcggcgttaggagcactaccattggttgggtcgacacctagacggccgcgcactcagtaaccaggcacacatggacacacccgaaggataagagtgcttcacagacgcgctgccccgcagagacagcgtaggactgtcccgccctccgaaacgcgcacctgggacttgctccccggagaccagacaaccgcctccctcagcgtggggcctcgccacccgctcgccgactcacctccctcagatgtcgcacggacactacaaacccccttgaatgcaggtgtgctcttacacgctcacactgacaaacaccagccccaagcacacaccgcctcactcccctcttctctccaaatgagcttcagtcaagttaccatttcataaagtttaccaacccaaagaatcaagggataaaatccaaacgcagaaaaagaatgcctaggagcaaattctaaaactcaccccggaaagttctcggtacccgtgcggagtgggagacagagaaagaagccggggaggggagtcaggtgggggaggggagtgagatgggccaagaggagagggcgagcataccaagggcagttccagacccgacccccgcgcgcacccggctcagccccaggtgcgcgccggtcgaaaccgggtctccaggctcggcccccgccccccacgcgggcacagactggctcccgactcccagagctcccagccccaccatttatcaaaaggacttgacaacaaaagaagagccggggcggaaaagcggaggaggggagattcaaagtcttctaagtcgttccgaggaagggggtgtgtcctcctccccaccccctctaatttctgcgagttcctggaggagaccctcgaacccgctccggacgctatcagagccccgataactcacgcagcgccacaggcatgcatacacactgggcatccaggtccaggtacccggtggcacgcacagcgcctccccttttcttcccaaacaacccgagtgacggtgcaaatcgaggggaacgcggcagtcccgctccgcttccctggaagaacccgcgttcccacaggcagccgccccctccctctctcgctccttccctcggctctcctagcgcagctcattccgactcggcgttccaataaattcgagagagcagccccgagttaccctggctccccagcctgcggggatggcggcaggtgggagaaggtcggggagggggcatgagtgagcctgagatgtttcttcccccatacacccatggccaggcctcttcttcgcagcctcttagccctgcttacgacccgagggggtcaaagaattgaggcgaggtttgccccaccattgacctccaggactagaagttccttggtggtgtggctcttagaagtctccgagtttggggttagggaactacagagggnggcagcctgacctccgcacgcaacacgccccgcgaggactcgcggcggcggggtggggtggcgggaaatctcccgtgttagaagttgccgccgctggtctcgggtacccggagccgcgcccgaactccgcgaccccaacagaccgaggctcccagaggtggaagggcgtctctccgacaccgagagggcaggcgcacactccaggcctgcgcgcccctctcggcgccctgggcgcacctgcgcactttactctcgctattcattttcctgacaccgtgcgcctctttcattctttttcttagagcccccaccccacccccatcccaggaggccgctcctcttttcccctcctccagttccctctcaatctcctccttcctctccgtctctctctccctctctctttttcccttcaagtcgcacccgccttgtaatcagcaacaaaagctgacataaatcacgggaggattgacaagagctgacaaataactgattgattgcggtcgaggaacattgacaattgatggaggggtggagatgcccaaagaagggggggagggaggaaaacagggtgggagagtaagaatggggggttgggggacagactgagggtgaaacagaggaaacatgtgacccccgctgctgccccaatctacgcgtccccgggcgtcacgtggccgggaagggcggagagcccagcgctcctcgcggtgttgagccgccgccgctgcgactgcccatctagcttctggtttctccgccgcggaatctgaggaaattagagcgggcgggcgggcttcttccagctccggctccccaccttgccttcttaccctggtggctgcgctgcgccgcgcgggatctcgattactgcgaaggaaaaaacactgggtgtgcaggttcccttcgcccctggagttgacagtccggccggtgtccacactcccaccggtgctccttctggacaccccccgcagtctgttcctcacgcgcaccccccttcaaaagaaggtttcagtttattttcgagctggggaaaggaagaacgacgaggaggaaaaaagagggaggcggcggatggcaaacgtagaataaatgtccatctcgtcctcccagcgaaatcgagggaggggacacacaggggggcggcgaagagggagctgcccattaaaaccggcactgagagtcctggcagcggcggcggcggcggcgcgggacgcgtcacatccccttgaccctccaatcacctcgggctcccatttgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggcctgctcgccgggaggtatgctgtcctcggccgggggtgccccggagggcaaggacgacaagaaagacaccgacgtgggcggcggtggcaagggcaccgggggcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatag

SEQ ID NO: 349515 - DNA, 1963 bp, Homo sapiens
  misc_feature (1143)..(1143): n is a, c, g, or t
  misc_feature (1150)..(1150): n is a, c, g, or t
atgctcattctaacctatcaccctactgttcattcatggaaccctaccgctggacagacaatgccacgcgcggcgtacgtgaaaactggtatctgcccgtactgtcgtgagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtacgttatttaatgtctgattgaaacacaaatttacatgcatgtttgttacaaaaaaaatgaaaaaaaaagtcacaatttgtcagctctgatttcaaattgcaattatttttaaggtgtataccatcgaagagaatgggtatttttttgtatgtattctggaagaaaacaacaaaaaaaaaaagaaaaagaaaaaattctattccaaaacctcatttgccttattttgttctttaaaaggaacacttaactatttttaatttttaagtccacccgctgagaaggggacaaggtttacgtcatgtactaaaataatagacaatgtatcgctttaaagattaaaattccgtatatttgatgtaaaaaaaaaaaaaanaaaaaanaaaaaaaaaaaaaaaaaaaaaaaaaaaaaaaaaaaaaaaaaaaaaaagaagaaaaaaaaaaaaaaaacaaaaaaaaggaaaaacaaaaaaaaaacaaaaagaaaaacaagaacaaagacgaacaataaaaaaaagagaagaacaggaaaggcacacaaaagaactaaccacgaacgaacaacagaacaagaggagaggaacaaaacagcggacacaaagcaggagcacaacagtcggagacaagaggcacagcaccaatagcctcgggaaggcagcgagcgacgcaacgcacagacgtggagtgaagcgaacgaaccgcacacaagagaagagacagaaacaacaacacacacacacgccacgatgggtagagaagaaaacagagtagagcgaacgagaccgaaagacgaagagaggagagcgaaaatccagtagaggggagacaaacaaaaggaggaggagagagcaaacgaagaggcgagcgacagaaggcgcgacaaaagaaagaacagagcaacgacagcgcgccgcaacacgcaggagggagagacggcacaagatgacgtacggacgaaggggagaagagacaagatcatagtccataaggacgaacggcggcaggagcaagcgcgcaaggaacaaggagaaagagaagagcggcacagcgtggagcccagggagcggagcggcccagacagcggagaacgaacgacagaagcacgaagcagcagagagagcggaggagcagagaagaagtagaggagaagaggacgagcaagaacgatgcagccaggggcaggggccggcgggggg

SEQ ID NO: 349516 - DNA, 6202 bp, Homo sapiens
  misc_feature (2209)..(2209): n is a, c, g, or t
acttacaaactgataggcttttaattgagcgcctccgccgagcccgagatgaaagggaagcggcggtgaaaggcggcccgcctgccctccggcctcaatactgattagccatctcgacagtgaatagttcaaggcattttcaaacttttttcctcagctctttccccttccttctcctcctcccaccccctcctccaatatctgccttgcccactccttttttagagaaaacaaatcatttccattgtttgcaaataaaatccgcaggacatccacgccaactgctgctgggggttggaggctttaggcctggcgcagagtaattaatggcccccactcccgggcccgcgccggccttcgggggtttggcctcctgcgcgaggtgcgcaggctcggacgctggcgcctcccaaaagccccgggcgcgcaggcccccaggcgcccccatgcgctcggaccctcggagtggagttttgagaaaagcgaacgcacgctgaccacgacccgcacccacgcagcacagcgcagccccacgagcgtgtgtggccacaccgggggacgcaggagccactccacggcccccccaggcttcaggtgctgaggctgcctcccctgagccgccggcgtaataagctgctggaattagaggagagggggaagagctgagtctggaggctggggagggacgcccttggctgcgtcccccccggccctgtcgcaggccccagaatttcagtgcccgggcctcgcggggaggccgcggcgatagcggcccaaaggtgggctcgcggcgttaggagcactaccattggttgggtcgacacctagacggccgcgcactcagtaaccaggcacacatggacacacccgaaggataagagtgcttcacagacgcgctgccccgcagagacagcgtaggactgtcccgccctccgaaacgcgcacctgggacttgctccccggagaccagacaaccgcctccctcagcgtggggcctcgccacccgctcgccgactcacctccctcagatgtcgcacggacactacaaacccccttgaatgcaggtgtgctcttacacgctcacactgacaaacaccagccccaagcacacaccgcctcactcccctcttctctccaaatgagcttcagtcaagttaccatttcataaagtttaccaacccaaagaatcaagggataaaatccaaacgcagaaaaagaatgcctaggagcaaattctaaaactcaccccggaaagttctcggtacccgtgcggagtgggagacagagaaagaagccggggaggggagtcaggtgggggaggggagtgagatgggccaagaggagagggcgagcataccaagggcagttccagacccgacccccgcgcgcacccggctcagccccaggtgcgcgccggtcgaaaccgggtctccaggctcggcccccgccccccacgcgggcacagactggctcccgactcccagagctcccagccccaccatttatcaaaaggacttgacaacaaaagaagagccggggcggaaaagcggaggaggggagattcaaagtcttctaagtcgttccgaggaagggggtgtgtcctcctccccaccccctctaatttctgcgagttcctggaggagaccctcgaacccgctccggacgctatcagagccccgataactcacgcagcgccacaggcatgcatacacactgggcatccaggtccaggtacccggtggcacgcacagcgcctccccttttcttcccaaacaacccgagtgacggtgcaaatcgaggggaacgcggcagtcccgctccgcttccctggaagaacccgcgttcccacaggcagccgccccctccctctctcgctccttccctcggctctcctagcgcagctcattccgactcggcgttccaataaattcgagagagcagccccgagttaccctggctccccagcctgcggggatggcggcaggtgggagaaggtcggggagggggcatgagtgagcctgagatgtttcttcccccatacacccatggccaggcctcttcttcgcagcctcttagccctgcttacgacccgagggggtcaaagaattgaggcgaggtttgccccaccattgacctccaggactagaagttccttggtggtgtggctcttagaagtctccgagtttggggttagggaactacagagggnggcagcctgacctccgcacgcaacacgccccgcgaggactcgcggcggcggggtggggtggcgggaaatctcccgtgttagaagttgccgccgctggtctcgggtacccggagccgcgcccgaactccgcgaccccaacagaccgaggctcccagaggtggaagggcgtctctccgacaccgagagggcaggcgcacactccaggcctgcgcgcccctctcggcgccctgggcgcacctgcgcactttactctcgctattcattttcctgacaccgtgcgcctctttcattctttttcttagagcccccaccccacccccatcccaggaggccgctcctcttttcccctcctccagttccctctcaatctcctccttcctctccgtctctctctccctctctctttttcccttcaagtcgcacccgccttgtaatcagcaacaaaagctgacataaatcacgggaggattgacaagagctgacaaataactgattgattgcggtcgaggaacattgacaattgatggaggggtggagatgcccaaagaagggggggagggaggaaaacagggtgggagagtaagaatggggggttgggggacagactgagggtgaaacagaggaaacatgtgacccccgctgctgccccaatctacgcgtccccgggcgtcacgtggccgggaagggcggagagcccagcgctcctcgcggtgttgagccgccgccgctgcgactgcccatctagcttctggtttctccgccgcggaatctgaggaaattagagcgggcgggcgggcttcttccagctccggctccccaccttgccttcttaccctggtggctgcgctgcgccgcgcgggatctcgattactgcgaaggaaaaaacactgggtgtgcaggttcccttcgcccctggagttgacagtccggccggtgtccacactcccaccggtgctccttctggacaccccccgcagtctgttcctcacgcgcaccccccttcaaaagaaggtttcagtttattttcgagctggggaaaggaagaacgacgaggaggaaaaaagagggaggcggcggatggcaaacgtagaataaatgtccatctcgtcctcccagcgaaatcgagggaggggacacacaggggggcggcgaagagggagctgcccattaaaaccggcactgagagtcctggcagcggcggcggcggcggcgcgggacgcgtcacatccccttgaccctccaatcacctcgggctcccatttgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacag

SEQ ID NO: 349517 - DNA, 6955 bp, Homo sapiens
  misc_feature (2209)..(2209): n is a, c, g, or t
  misc_feature (6135)..(6135): n is a, c, g, or t
  misc_feature (6142)..(6142): n is a, c, g, or t
acttacaaactgataggcttttaattgagcgcctccgccgagcccgagatgaaagggaagcggcggtgaaaggcggcccgcctgccctccggcctcaatactgattagccatctcgacagtgaatagttcaaggcattttcaaacttttttcctcagctctttccccttccttctcctcctcccaccccctcctccaatatctgccttgcccactccttttttagagaaaacaaatcatttccattgtttgcaaataaaatccgcaggacatccacgccaactgctgctgggggttggaggctttaggcctggcgcagagtaattaatggcccccactcccgggcccgcgccggccttcgggggtttggcctcctgcgcgaggtgcgcaggctcggacgctggcgcctcccaaaagccccgggcgcgcaggcccccaggcgcccccatgcgctcggaccctcggagtggagttttgagaaaagcgaacgcacgctgaccacgacccgcacccacgcagcacagcgcagccccacgagcgtgtgtggccacaccgggggacgcaggagccactccacggcccccccaggcttcaggtgctgaggctgcctcccctgagccgccggcgtaataagctgctggaattagaggagagggggaagagctgagtctggaggctggggagggacgcccttggctgcgtcccccccggccctgtcgcaggccccagaatttcagtgcccgggcctcgcggggaggccgcggcgatagcggcccaaaggtgggctcgcggcgttaggagcactaccattggttgggtcgacacctagacggccgcgcactcagtaaccaggcacacatggacacacccgaaggataagagtgcttcacagacgcgctgccccgcagagacagcgtaggactgtcccgccctccgaaacgcgcacctgggacttgctccccggagaccagacaaccgcctccctcagcgtggggcctcgccacccgctcgccgactcacctccctcagatgtcgcacggacactacaaacccccttgaatgcaggtgtgctcttacacgctcacactgacaaacaccagccccaagcacacaccgcctcactcccctcttctctccaaatgagcttcagtcaagttaccatttcataaagtttaccaacccaaagaatcaagggataaaatccaaacgcagaaaaagaatgcctaggagcaaattctaaaactcaccccggaaagttctcggtacccgtgcggagtgggagacagagaaagaagccggggaggggagtcaggtgggggaggggagtgagatgggccaagaggagagggcgagcataccaagggcagttccagacccgacccccgcgcgcacccggctcagccccaggtgcgcgccggtcgaaaccgggtctccaggctcggcccccgccccccacgcgggcacagactggctcccgactcccagagctcccagccccaccatttatcaaaaggacttgacaacaaaagaagagccggggcggaaaagcggaggaggggagattcaaagtcttctaagtcgttccgaggaagggggtgtgtcctcctccccaccccctctaatttctgcgagttcctggaggagaccctcgaacccgctccggacgctatcagagccccgataactcacgcagcgccacaggcatgcatacacactgggcatccaggtccaggtacccggtggcacgcacagcgcctccccttttcttcccaaacaacccgagtgacggtgcaaatcgaggggaacgcggcagtcccgctccgcttccctggaagaacccgcgttcccacaggcagccgccccctccctctctcgctccttccctcggctctcctagcgcagctcattccgactcggcgttccaataaattcgagagagcagccccgagttaccctggctccccagcctgcggggatggcggcaggtgggagaaggtcggggagggggcatgagtgagcctgagatgtttcttcccccatacacccatggccaggcctcttcttcgcagcctcttagccctgcttacgacccgagggggtcaaagaattgaggcgaggtttgccccaccattgacctccaggactagaagttccttggtggtgtggctcttagaagtctccgagtttggggttagggaactacagagggnggcagcctgacctccgcacgcaacacgccccgcgaggactcgcggcggcggggtggggtggcgggaaatctcccgtgttagaagttgccgccgctggtctcgggtacccggagccgcgcccgaactccgcgaccccaacagaccgaggctcccagaggtggaagggcgtctctccgacaccgagagggcaggcgcacactccaggcctgcgcgcccctctcggcgccctgggcgcacctgcgcactttactctcgctattcattttcctgacaccgtgcgcctctttcattctttttcttagagcccccaccccacccccatcccaggaggccgctcctcttttcccctcctccagttccctctcaatctcctccttcctctccgtctctctctccctctctctttttcccttcaagtcgcacccgccttgtaatcagcaacaaaagctgacataaatcacgggaggattgacaagagctgacaaataactgattgattgcggtcgaggaacattgacaattgatggaggggtggagatgcccaaagaagggggggagggaggaaaacagggtgggagagtaagaatggggggttgggggacagactgagggtgaaacagaggaaacatgtgacccccgctgctgccccaatctacgcgtccccgggcgtcacgtggccgggaagggcggagagcccagcgctcctcgcggtgttgagccgccgccgctgcgactgcccatctagcttctggtttctccgccgcggaatctgaggaaattagagcgggcgggcgggcttcttccagctccggctccccaccttgccttcttaccctggtggctgcgctgcgccgcgcgggatctcgattactgcgaaggaaaaaacactgggtgtgcaggttcccttcgcccctggagttgacagtccggccggtgtccacactcccaccggtgctccttctggacaccccccgcagtctgttcctcacgcgcaccccccttcaaaagaaggtttcagtttattttcgagctggggaaaggaagaacgacgaggaggaaaaaagagggaggcggcggatggcaaacgtagaataaatgtccatctcgtcctcccagcgaaatcgagggaggggacacacaggggggcggcgaagagggagctgcccattaaaaccggcactgagagtcctggcagcggcggcggcggcggcgcgggacgcgtcacatccccttgaccctccaatcacctcgggctcccatttgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggcctgctcgccgggaggtatgctgtcctcggccgggggtgccccggagggcaaggacgacaagaaagacaccgacgtgggcggcggtggcaagggcaccgggggcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtacgttatttaatgtctgattgaaacacaaatttacatgcatgtttgttacaaaaaaaatgaaaaaaaaagtcacaatttgtcagctctgatttcaaattgcaattatttttaaggtgtataccatcgaagagaatgggtatttttttgtatgtattctggaagaaaacaacaaaaaaaaaaagaaaaagaaaaaattctattccaaaacctcatttgccttattttgttctttaaaaggaacacttaactatttttaatttttaagtccacccgctgagaaggggacaaggtttacgtcatgtactaaaataatagacaatgtatcgctttaaagattaaaattccgtatatttgatgtaaaaaaaaaaaaaanaaaaaanaaaaaaaaaaaaaaaaaaaaaaaaaaaaaaaaaaaaaaaaaaaaaaagaagaaaaaaaaaaaaaaaacaaaaaaaaggaaaaacaaaaaaaaaacaaaaagaaaaacaagaacaaagacgaacaataaaaaaaagagaagaacaggaaaggcacacaaaagaactaaccacgaacgaacaacagaacaagaggagaggaacaaaacagcggacacaaagcaggagcacaacagtcggagacaagaggcacagcaccaatagcctcgggaaggcagcgagcgacgcaacgcacagacgtggagtgaagcgaacgaaccgcacacaagagaagagacagaaacaacaacacacacacacgccacgatgggtagagaagaaaacagagtagagcgaacgagaccgaaagacgaagagaggagagcgaaaatccagtagaggggagacaaacaaaaggaggaggagagagcaaacgaagaggcgagcgacagaaggcgcgacaaaagaaagaacagagcaacgacagcgcgccgcaacacgcaggagggagagacggcacaagatgacgtacggacgaaggggagaagagacaagatcatagtccataaggacgaacggcggcaggagcaagcgcgcaaggaacaaggagaaagagaagagcggcacagcgtggagcccagggagcggagcggcccagacagcggagaacgaacgacagaagcacgaagcagcagagagagcggaggagcagagaagaagtagaggagaagaggacgagcaagaacgatgcagccaggggcaggggccggcgggggg

SEQ ID NO: 349518 - DNA, 1731 bp, Homo sapiens
  misc_feature (18)..(18): n is a, c, g, or t
  misc_feature (911)..(911): n is a, c, g, or t
  misc_feature (918)..(918): n is a, c, g, or t
tgtcccgggaaatgccgntgggtccgcaagtggctcagcagctcttcgccgtggcgaacgcttgtcgcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtacgttatttaatgtctgattgaaacacaaatttacatgcatgtttgttacaaaaaaaatgaaaaaaaaagtcacaatttgtcagctctgatttcaaattgcaattatttttaaggtgtataccatcgaagagaatgggtatttttttgtatgtattctggaagaaaacaacaaaaaaaaaaagaaaaagaaaaaattctattccaaaacctcatttgccttattttgttctttaaaaggaacacttaactatttttaatttttaagtccacccgctgagaaggggacaaggtttacgtcatgtactaaaataatagacaatgtatcgctttaaagattaaaattccgtatatttgatgtaaaaaaaaaaaaaanaaaaaanaaaaaaaaaaaaaaaaaaaaaaaaaaaaaaaaaaaaaaaaaaaaaaagaagaaaaaaaaaaaaaaaacaaaaaaaaggaaaaacaaaaaaaaaacaaaaagaaaaacaagaacaaagacgaacaataaaaaaaagagaagaacaggaaaggcacacaaaagaactaaccacgaacgaacaacagaacaagaggagaggaacaaaacagcggacacaaagcaggagcacaacagtcggagacaagaggcacagcaccaatagcctcgggaaggcagcgagcgacgcaacgcacagacgtggagtgaagcgaacgaaccgcacacaagagaagagacagaaacaacaacacacacacacgccacgatgggtagagaagaaaacagagtagagcgaacgagaccgaaagacgaagagaggagagcgaaaatccagtagaggggagacaaacaaaaggaggaggagagagcaaacgaagaggcgagcgacagaaggcgcgacaaaagaaagaacagagcaacgacagcgcgccgcaacacgcaggagggagagacggcacaagatgacgtacggacgaaggggagaagagacaagatcatagtccataaggacgaacggcggcaggagcaagcgcgcaaggaacaaggagaaagagaagagcggcacagcgtggagcccagggagcggagcggcccagacagcggagaacgaacgacagaagcacgaagcagcagagagagcggaggagcagagaagaagtagaggagaagaggacgagcaagaacgatgcagccaggggcaggggccggcgggggg

SEQ ID NO: 349519 - DNA, 4884 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcaagctataagcgagcaattggtgaggactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349520 - DNA, 559 bp, Homo sapiens
atagtatcattataaggcattacttcattagcccaatatttctgcatgtggttacatctgatcgatccgctcatctcagcatattattttccggagtgatagctattaactaggattcttctcgtactgttgagcgaacacggatgagcaatgttcatatttcctacccagttatttggaacggcacatatggagtattcaaaatccgctccctgttgccgttagtggggggcttaagtctctctgattgaggtatagcctgtggacggtgtgagttgagtaccggccctcggtgttccgggcccgggtttttctggagtcgggttgcttgggaatgtagcccaaagcgggtggtaaaccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349521 - DNA, 867 bp, Homo sapiens
atctgcaaaggcgggcagagcggggcaccccaaagcctccagggccccctgctcagccccctggcccgcccaacgcctctagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagtgagtcacctggtggcaggcatggcctgcctcatcctggtttggggcttagcctcagggtgctgggtgtcaggggtggggtctccgctgatctaccgagaagggctgtggggatggagggactggtgcttctcatggtgctaacctttcctaacctctctcctaacctctctcctaacctctcttctggctctttcttcccctgcggcccctcccagagctataagcgagcaattggtgaggttagtgagatgggcctgcttgtgggagcccctcctgtcgccctgctggggtgtcccggcaccctttgtctacctccacccaggcccagcttctccctgcccctcacgtggctcctccctgcaggactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccggtacggcatcgggagtggggccctcccactccaaggcacagggagggagggga

SEQ ID NO: 349522 - DNA, 279 bp, Homo sapiens
ggaagaggtggggctttggggcaagtctgagggagagcggctcccttctctagagagtggggtgagggtgcaggttcctgtctctctcccgctgccctgtgtgttgtggggtggcctcttcaagtgcctgtctgcccctgtgccagcctgccctgtgtgccatgcagggaagcacctcacggtggagcaggggctacaccgtgagggtggagcaggttgtgttttgaatagagacaaaagcctgggctctggctgccatctgctgcctttggcacttct

SEQ ID NO: 349523 - DNA, 263 bp, Homo sapiens
agtagcaggcaccaagtaggggaaaggagcacacagcacagagcatagggcgggagtagttagggcaggtgggaccctcagttttgagaacagggaggcaagagctggcctgcttgacatcccttcacatcacaggtagaagagagaacaaggatgaacaagcagcagaactctcccttggccaagagcaagccaggcagcacggggcctgagccccccatcccccaggcaggaaggtgctataggaacttcgtaaaactagg

SEQ ID NO: 349524 - DNA, 4860 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349525 - DNA, 4985 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccaccatgcaggccgcatgtccttgctttctgtcagtactgtagactaggcagagagagcctccagggtggggaagaaaggggcagggtgggctgggatctgcaatgagtgagcctcatggggtgggatgg

SEQ ID NO: 349526 - DNA, 5124 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccattcataaaatgaatgtgggtgaagccgccctaaggattttcctttaatttctttggagtaatactgtaccatactgggctttgcttttagtaataaaacatcaaattaggtttggaggggaactttgaacttttctaagaaattaaagttggccaaaataattctggaatggggcttttaaattccctttaagggctttgaaaataat

SEQ ID NO: 349527 - DNA, 4631 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccacagcctacccgtcttccgcagcctagtgg

SEQ ID NO: 349528 - DNA, 5179 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatatattcgtcacaggctagaggaggagcagcgacagctcgagatccttcagcaacagctgctccaggaacaggccctgctgctggtaacgggtccctcagcgtcctctgggaagatgcttttcagagcttctttgctggaacgggatgggaacacttcaagggaagggattcacccaggacatcaagggaatacatctcctctctaggcagttggagaaaagagagggcatgcctgctctaactcccagggccacaccctgctgagccctctctccctacccttgggcccaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcaagctataagcgagcaattggtgaggactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349529 - DNA, 4947 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatatattcgtcacaggctagaggaggagcagcgacagctcgagatccttcagcaacagctgctccaggaacaggccctgctgctggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349530 - DNA, 2660 bp, Homo sapiens
atctgcaaaggcgggcagagcggggcaccccaaagcctccagggccccctgctcagccccctggcccgcccaacgcctctagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349531 - DNA, 1992 bp, Homo sapiens
gctcctctcctcctgtctttctcctcctttctgcgtattatgaggtgccaagacctgatataggggatggaggtaaaaagagatggggtgagaagctgcagcccctcctcccacctcctcctccttctggcagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349532 - DNA, 4913 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaagttgagacacccccccaacctcagcccttggtgacttcttctcctgccccaccagtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349533 - DNA, 3231 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccccctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349534 - DNA, 3945 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcaggacacaccaccaagactcttgttcagagtgcctacctgaggctgaggcttaatcggaacatcagataccatcttctctcctccactctccaaccaccacactaacaagctttgagaagaataacagtggaatacaacttggagaaccatgcaaagggagacccaaagccaaggagggacactcatagccaagcagatagcagtcttca

SEQ ID NO: 349535 - DNA, 895 bp, Homo sapiens
  misc_feature (17)..(17): n is a, c, g, or t
tggctggtcctgggtgnggagtcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349536 - DNA, 1240 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtgacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagtcccatcatgtaacagatgccatcgagcattgactatacgccagggactgcatcctggcttcatacagg

SEQ ID NO: 349537 - DNA, 496 bp, Homo sapiens
cattcgatctagaggatcccgaggcatcacgatgtccgtaggtcatcgaccggtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggatccatcgtttcccgggggcgaacctcacatctaggaccgagc

SEQ ID NO: 349538 - DNA, 363 bp, Homo sapiens
acatggagggctgcgggcactaccgtgttggtgaggatgtcccaacagagtggccagcgcatacttgttcatgaagagagaaatggatctgggagccagggacttggggcctgggtggggcagtgtagtgacagaccacggggaggcgcccgtggcgcaagaagggaagtctcagcatccctcttctctcccgcccccagtgaaatacgagcggattaagttcctggtcatcgccctcaagagctccgtggaggtgtatgcctgggcccccaaaccctaccacaaattcatggccttcaaggtaatcccagcctcggtccctaacaccatctggagtcccagcgcctctccccgtgcccctga

SEQ ID NO: 349539 - DNA, 877 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgaccgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccattcataaaatgaatgtgggtgaagccgccctaaggattttcctttaatttctttggagtaatactgtaccatactgggctttgcttttagtaataaaacatcaaattaggtttggaggggaactttgaacttttctaagaaattaaagttggccaaaataattctggaatggggcttttaaattccctttaagggctttgaaaataat

SEQ ID NO: 349540 - DNA, 557 bp, Homo sapiens
  misc_feature (546)..(546): n is a, c, g, or t
cattcgatctagaggatcccgaggcatcacgatgtccgtaggtcatcgaccggtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggatttgggggtgagtgtcagctggacgnaccgtgggcga

SEQ ID NO: 349541 - DNA, 4733 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccatccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349542 - DNA, 4847 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcatttatcactaaactctacattcctggttgttaacacttctgtttactagagcggagcattaaatgtataccctttctaatcttcctttccttaagtcctttattttaaattgttaaatatgctcggagattaaataac

SEQ ID NO: 349543 - DNA, 4666 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccctcctcaatgtagtggccttggatatcctgtttgttaataaagacaattcaaccagctcccacca

SEQ ID NO: 349544 - DNA, 4180 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccctggagcaggttctgggaccctctgcggtacgagtcgatcgagaggggtacca

SEQ ID NO: 349545 - DNA, 4800 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349546 - DNA, 2902 bp, Homo sapiens
atctgcaaaggcgggcagagcggggcaccccaaagcctccagggccccctgctcagccccctggcccgcccaacgcctctagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagtgagtcacctggtggcaggcatggcctgcctcatcctggtttggggcttagcctcagggtgctgggtgtcaggggtggggtctccgctgatctaccgagaagggctgtggggatggagggactggtgcttctcatggtgctaacctttcctaacctctctcctaacctctctcctaacctctcttctggctctttcttcccctgcggcccctcccagagctataagcgagcaattggtgaggactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349547 - DNA, 5248 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgggaggctccttccctctgaaagccctgctgtcccggctgccatgaccctaggcccctgggcagagttctggggagaggatggtggtggtggcttcctgaaagcgggcccctctgggagctcggagggcagtcagccactaccactgccctgcgctcccttcagattccgaggacttcccagctggcccccagggggcgagtggtgcaccctctcccctaacatcccagcctgcctttcctccgggtgaggggcactgtgagtctcctcctgcagtctctgtgtctccctcaactcttctgccaccccttcttcccttctttccctctcccagttgagacacccccccaacctcagcccttggtgacttcttctcctgccccaccagtgttttttgcctcagtccgctctgggggcagcagccaagtttacttcatgactctgaaccgtaactgcatcatgaactggtgacggggccctgggctggggctgtcccacactggacccagctctccccctgcagccaggcttcccgggccgcccctctttcccctccctgggcttttgcttttactggtttgatttcactggagcctgctgggaacgtgacctctgacccctgatgctttcgtgatcacgtgaccatcctcttccccaacatgtcctcttcccaaaactgtgcctgtccccagcttctggggagggacacagcttccccttcccaggaattgagtgggcctagcccctccccccttttctccatttgagaggagagtgcttggggcttgaaccccttaccccactgctgctgactgggcagggccctggacccctttatttgcacgtcaggggagccggctccccccttgaatgtaccagaccctggggggggtcactgggccctagatttttggggggtcaccagccactccaggggcagggaccatttcttcattttctgaaagcactttaatgattccccttcccccaaactccagggaatggaggggggaccccgccagccaaaacattccccccattcccgacccccatctcctcttctagcccatgcccttccccggtggagggagggagcagggagccctcactctccacgccccttgcttgcatctgtatatagtgtgagcagcaagtaacccttctcctccctcccccctcacccctcctcaatgtagtggccttggatatcctgtttgttaataaagacaattcaaccagctcccacca

SEQ ID NO: 349548 - DNA, 4576 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctccagtgctggcttccatgctgtggatgtcgactcggggaacagctatgacatctacatccctgtgcacatccagagccagatcacgccccatgccatcatcttcctccccaacaccgacggcatggagatgctgctgtgctacgaggacgagggtgtctacgtcaacacgtacgggcgcatcattaaggatgtggtgctgcagtggggggagatgcctacttctgtggcctacatctgctccaaccagataatgggctggggtgagaaagccattgagatccgctctgtggagacgggccacctcgacggggtcttcatgcacaaacgagctcagaggctcaagttcctgtgtgagcggaatgacaaggtgggaggctccttccctctgaaagccctgctgtcccggctgccatgaccctaggcccctgggcagagttctggggagaggatggtggtggtggcttcctgaaagcgggcccctctgggagctcggagggcagtcagccactaccactgccctgcgctcccttcagattccgaggacttcccagctggcccccagggggcgagtggtgcaccctctcccctaacatcccagcctgcctttcctccgggtgaggggcactgtgagtctcctcctgcagtctctgtgtctccctcaactcttctgccaccccttcttcccttctttccctctcccagttgagacacccccccaacctcagcccttggtgacttcttctcctgccccaccacagagcggactgaggcaaaaaaacaccttgtcattccgctcacacaggaacttgagcctctgagctcgtttgtgcatgaagaccccgtcgaggtggcccgtctccacagagcggatctcaatggctttctcaccccagcccattatctggttggagcagatgtaggccacagaagtaggcatctccccc

SEQ ID NO: 349549 - DNA, 3738 bp, Homo sapiens
gctggctccggggagatagcgcctgtcagtcggtgggtcggtcctcgcgccggccctccccctccccggtctccgggggaggcgcggtggagtccgcccccggggttctccgatgggggagaagcggcgacggcggcagtggagtaaccgagccggagcgtgagcggccccggtgccccgttccccacggaggccatgggcgacccagcccccgcccgcagcctggacgacatcgacctgtccgccctgcgggaccctgctgggatctttgagcttgtggaggtggtcggcaatggaacctacggacaggtgtacaagggtcggcatgtcaagacggggcagctggctgccatcaaggtcatggatgtcacggaggacgaggaggaagagatcaaacaggagatcaacatgctgaaaaagtactctcaccaccgcaacatcgccacctactacggagccttcatcaagaagagccccccgggaaacgatgaccagctctggctggtgatggagttctgtggtgctggttcagtgactgacctggtaaagaacacaaaaggcaacgccctgaaggaggactgtatcgcctatatctgcagggagatcctcaggggtctggcccatctccatgcccacaaggtgatccatcgagacatcaaggggcagaatgtgctgctgacagagaatgctgaggtcaagctagtggattttggggtgagtgctcagctggaccgcaccgtgggcagacggaacactttcattgggactccctactggatggctccagaggtcatcgcctgtgatgagaaccctgatgccacctatgattacaggagtgatatttggtctctaggaatcacagccatcgagatggcagagggagccccccctctgtgtgacatgcaccccatgcgagccctcttcctcattcctcggaaccctccgcccaggctcaagtccaagaagtggtctaagaagttcattgacttcattgacacatgtctcatcaagacttacctgagccgcccacccacggagcagctactgaagtttcccttcatccgggaccagcccacggagcggcaggtccgcatccagcttaaggaccacattgaccgatcccggaagaagcggggtgagaaagaggagacagaatatgagtacagcggcagcgaggaggaagatgacagccatggagaggaaggagagccaagctccatcatgaacgtgcctggagagtcgactctacgccgggagtttctccggctccagcaggaaaataagagcaactcagaggctttaaaacagcagcagcagctgcagcagcagcagcagcgagaccccgaggcacacatcaaacacctgctgcaccagcggcagcggcgcatagaggagcagaaggaggagcggcgccgcgtggaggagcaacagcggcgggagcgggagcagcggaagctgcaggagaaggagcagcagcggcggctggaggacatgcaggctctgcggcgggaggaggagcggcggcaggcggagcgcgagcaggaatacaagcggaagcagctggaggagcagcggcagtcagaacgtctccagaggcagctgcagcaggagcatgcctacctcaagtccctgcagcagcagcaacagcagcagcagcttcagaaacagcagcagcagcagctcctgcctggggacaggaagcccctgtaccattatggtcggggcatgaatcccgctgacaaaccagcctgggcccgagaggtagaagagagaacaaggatgaacaagcagcagaactctcccttggccaagagcaagccaggcagcacggggcctgagccccccatcccccaggcctccccagggcccccaggacccctttcccagactcctcctatgcagaggccggtggagccccaggagggaccgcacaagagcctggtggcacaccgggtcccactgaagccatatgcagcacctgtaccccgatcccagtccctgcaggaccagcccacccgaaacctggctgccttcccagcctcccatgaccccgaccctgccatccccgcacccactgccacgcccagtgcccgaggagctgtcatccgccagaattcagaccccacctctgaaggacctggccccagcccgaatcccccagcctgggtccgcccagataacgaggccccacccaaggtgcctcagaggacctcatctatcgccactgcccttaacaccagtggggccggagggtcccggccagcccaggcagtccgtgccagtaaccccgacctcaggaggagcgaccctggctgggaacgctcggacagcgtccttccagcctctcacgggcacctcccccaggctggctcactggagcggaaccgcgtgggagtctcctccaaaccggacagctcccctgtgctctcccctgggaataaagccaagcccgacgaccaccgctcacggccaggccggcccgcagactttgtgttgctgaaagagcggactctggacgaggcccctcggcctcccaagaaggccatggactactcgtcgtccagcgaggaggtggaaagcagtgaggacgacgaggaggaaggcgaaggcgggccagcagaggggagcagagatacccctgggggccgcagcgatggggatacagacagcgtcagcaccatggtggtccacgacgtcgaggagatcaccgggacccagcccccatacgggggcggcaccatggtggtccagcgcacccctgaagaggagcggaacctgctgcatgctgacagcaatgggtacacaaacctgcctgacgtggtccagcccagccactcacccaccgagaacagcaaaggccaaagcccaccctcgaaggatgggagtggtgactaccagtctcgtgggctggtaaaggcccctggcaagagctcgttcacgatgtttgtggatctagggatctaccagcctggaggcagtggggacagcatccccatcacagccctagtgggtggagagggcactcggctcgaccagctgcagtacgacgtgaggaagggttctgtggtcaacgtgaatcccaccaacacccgggcccacagtgagacccctgagatccggaagtacaagaagcgattcaactccgagatcctctgtgcagccctttggggggtcaacctgctggtgggcacggagaacgggctgatgttgctggaccgaagtgggcagggcaaggtgtatggactcattgggcggcgacgcttccagcagatggatgtgctggaggggctcaacctgctcatcaccatctcagggaaaaggaacaaactgcgggtgtattacctgtcctggctccggaacaagattctgcacaatgacccagaagtggagaagaagcagggctggaccaccgtgggggacatggagggctgcgggcactaccgtgttgtgaaatacgagcggattaagttcctggtcatcgccctcaagagctccgtggaggtgtatgcctgggcccccaaaccctaccacaaattcatggccttcaagtcctttgccgacctcccccaccgccctctgctggtcgacctgacagtagaggaggggcagcggctcaaggtcatctatggctcacacctgcgtccgccagcacacacaaacgcacaagcacacacgcacacacagcacacacacgcgaacgcagcacacacgaacacagcacacacagcacacacacgg

SEQ ID NO: 349550 - DNA, 341 bp, Homo sapiens
tggctgccatctgctgcctttggcacttctgtggccacgggcaggacctggaggggccccaccttcctctctcacagcagcgatggggatacagacagcgtcagcaccatggtggtccacgacgtcgaggagatcaccgggacccagcccccatacgggggcggcaccatggtggtccagcgcgtgagtgagcctctgctccctcccctgtacctgtgtgtgccctcctcagccccacgccaaccctgccctctgtcctgtagacccctgaagaggagcggaacctgctgcatgctgacagcaatgggtacacaaacctgcctgacgtggtccagcccagc

SEQ ID NO: 349551 - DNA, 1912 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaa

SEQ ID NO: 349552 - DNA, 757 bp, Homo sapiens
ccaggatagactaacgtctgaaagtcaagcattgcaaagagttaagtgactaggtatcccataaggagatgttgccaacctctgttgagacattggataatgttattaacactattgtttgaagtagtgaatggagtctcaaaattcacctaatcttccaaacattttttgaagtatttatactttttaattgtatatatacagtaaatgcacaagtcttaaatgtacagtataatggattttttgtatttatacacttgcctaactacctgggttaggtctacctggccaggtagacccaaccattactacttgaacccccttagaaaagcttttccagcattccataactcaggttcctcatttataaagtgggaaactcataattgtcctacctacctcacaggggtgttgtgaggatcaaaggaacagatgaatgtatgagcactttcagacatgtaaggcactgtcatgtaacaagtaggggaaagactctggagcacattagtgctggtgtgtgccaagcccgtgggctgttgaccgtaagggatattcaagtaggaggaggaagagaagatggcattgctaataaaggttgtgatacacaaccataggattaactgcctcctcaagtccatcatgtaaataaggtgctatgtataccaacttctcaccacctttgtttttctgttcggtaatcctggtgtggacaaataaagttttcacttgtatgtagttgtgggtcagtccactactt

SEQ ID NO: 349553 - DNA, 787 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaaggatacttatgcactaagccaaaaactatagttgtttggagagaattcaatattcagtgacaataaatacatccccatctcattcccctgtggccttccagccagaaatgcggtccttggacctggcttctcagcaattatccctgagagggaagatcctggagatatcctgagagcacacagagcttccccacaccttcagacttgcaccttgctgtccagaagctgcctagccctcctttccaacccacaatggccagtgccaatagcagtgccggggaggccccccaaattttttccccccccggggggtttttttc

SEQ ID NO: 349554 - DNA, 4832 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagccagaaatgcggtccttggacctggcttctcagcaattatccctgagagggaagatcctggagatatcctgagagcacacagagcttccccacaccttcagacttgcaccttgctgtccagaagctgcctagccctcctttccaacccacaatggccagtgccaatagcagtgcgggcatccggtggtccagacaggagacacgaactcttctctccatactaggcgaggcagagtatattcagcgcctccagactgtgcatcacaatgcagatgtctatcaggctgtgtctaagcgaatgcagcaggagggcttccgccgcaccgaacgtcagtgccgctccaagtttaaagttctgaaggcattatatttaaaggcctatgttgcccatgccacaagtatgggtgagccaccacactgtccattttatgatacgttggatcagcttctccgaaatcagatagtgactgacccagacaacttaatggaggatgctgcttgggccaagcactgtgatcagaacttagtggcctctgacgccccaggggaagagggaaccggcattctaaaatcaaaaaggactcaggcagctgatcatcagcctatcttgaaaacagttaaggcatcagatgaggattgtcagctaagaatcagtgaccggatacgagaaaccagtgaccttgaggactcctgggatgaatcctcgggtgcagggtgctctcaagggacccccagctacagcagctcccacagccttttcagaggtgcagttgctccctgtcagagcagccccatggccagactgggtgtgtccggggagcccagcccctgcaccagcaccaaccgcagcactcctggggtagcctccacaccgcagactccagtctcctcttcgagagctggttttgtttctggtggggataggcccttgaccagtgagccccctccaaggtgggcaaggcgaagaaggcggtcagtggccaggactatcgcagccgagttggcagaaaacaggcgattggcacgagaactctcaaagcgggaggaagaaaaactggacaggctgattgctattggtgaggaggccagtgctcagcaagatactgccaatgagctccgcagggatgctgtcatcgcagtcagacgtttggcaacagcagtggaagaggcaactggtgcttttcagctaggccttgaaaaattgcttcagaggttgatttcgaataccaaaagctaggaaccaattacaaaaggctctgcttcctaaactggtagaagtctagttcccaaacctgccttctgaatccctggctccttttctgtgtcctcagaaaaaaacatggatgaaccatttatatccagatagtatgaaaataattgctagttcattttcccaagattctccaccaaatggaagacctttcagaaatgccaggggtgacctaatagaaaacgatggagccacgttctagacagctggttcatcctagctttgtcacagatgtgaagcagtttacctccctccagtggtttcctcatccgtaaaatggggatcaataataactcctgccctgcctacctcacagggttgttgtgaggatcacgtagttcatagatgtgaaagggtttaaaagtttaaaagcactgtacacatttaagttattaattcatatggccttggctgaggtaaggcagattggtttacaagatacagaagtatggatatatactgtgacttcattgcttgaatctttcctttgctggtctaacttgactgcttcatggagtttgaaatcttaatttttaaaatccctgtgtggctcattagacgactataagcacaacctgtatttgtaccttaatctcttacatttccactgctgtgtatctgacatatctactagtaagcactgttttgtcaaaccgtctttctctccttcattttactggttcttagtctcctatcaatataaggaaataagaagtgccagggagccgccattgtgtgttacggtttatatcgataatcttcaatataaaatactggccattttataaaatattaaatatatgtaaattctttgcatttcatattatttgggtccctttatatgcctaaattacatctttaagtttcggttgccattggaacattgtggaaacaattcagattatatcagtttcccatccgctttttagctgatttcattcttttctgttatttttttgtctagtatgttatacagggcaagccctagaaacgtttccttttgaggagctttccaagattccttttcctcagatgttgtagacagaagtttatgtagttaatggcatctggtggaagagaacagctttgtttcctctttaactttgggaacactagaggatggtgtggataaagattgcctgcaatagatgactccttttaagcactagccgtgaacagatgagcctcctccacaccccagacacacactggggagagatgaaggtgataagccacacttccgatttactctagaagggaagacattactctctgtcattaaactaacttaaagcttttagtgatttacttagtacttttaggaatacaaataggaatctttaggatttaaaaagttttccaataatctagaagttggaaaaataacaaagagtgggcatgttgggggaggttttattttctatcttgcaggctcgagtgcttagctaaatgctggaaatggacataggtggagaaatggtcagagcagcagtgggagcgtacccagaaccatgagtagacggcaagcgagctgctctgccaagccagggatggaggtgtgaggcggctggtgtggtagaatatgttggaatctagttagaattcctggattggaatcctgtcacagtttgtttcatcagacaaatcacttgcccttttctattattattatttttttttttttgagaaaaagtctcactgttttgcccaggctggggtgcagtggtgcaatcttggctcactgcaacctcagcctcccgagtagccgggattacaggtgcatgccaacatgcccaactcatttttgtatttttagtagagacggggtttcaccatgttggccaggctagtcttgaactcctgacctcaggtgatccacctgcctcggcctcccaaagtgctgagattacaggcgtgagccaccgtgcccagccaattcatgcctcaatttctttatctccggattgagggatttgtattagattttttttttcctagtaccttccagctctaaaaaaatttgaaatagcataataaaagacaaaatgaaaacgaaattttaattgtaatattttctgtcacagcagcatatgtatatttgaaatactggtaacaattttaaggtagcattctgtggtattaatatttattaatatgctcatgaacttctaagtgccacaccagacatatagactctttactttaaaagagcatatatttaaggcattgaaatggatacagctatattcattctcaattgtcttaggctattatatggaaagatatgtgtcaattataggtaggtaggtaggtaggtagattttctggaaacacagaagtacttgacggagagttaggcctgtattctataaatctattaatggtagcaaagtgcataagacagggatttctttgagatgaaaggagtgctgaagaagagcattggaattaatatttggatgtggtattgtgaaattcaatgggtaaagtaaccctaatgtgggaataaaagtcaagggaaaggtcttgaataagtacacagaaaaataggctaaaaatattaaggggagggaaattggaatacagggagacagtgtgcaagaaagcaagccaggaatctgcctatgtggtagacccaaccattactacttgaacccccttagaaaagcttttccagcattccataactcaggttcctcatttataaagtgggaaactcataattgtcctacctacctcacaggggtgttgtgaggatcaaaggaacagatgaatgtatgagcactttcagacatgtaaggcactgtcatgtaacaagtaggggaaagactctggagcacattagtgctggtgtgtgccaagcccgtgggctgttgaccgtaagggatattcaagtaggaggaggaagagaagatggcattgctaataaaggttgtgatacacaaccataggattaactgcctcctcaagtccatcatgtaaataaggtgctatgtataccaacttctcaccacctttgtttttctgttcggtaatcctggtgtggacaaataaagttttcacttgtatgtagttgtgggtcagtccactactt

SEQ ID NO: 349555 - DNA, 4181 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagccagaaatgcggtccttggacctggcttctcagcaattatccctgagagggaagatcctggagatatcctgagagcacacagagcttccccacaccttcagacttgcaccttgctgtccagaagctgcctagccctcctttccaacccacaatggccagtgccaatagcagtgcgggcatccggtggtccagacaggagacacgaactcttctctccatactaggcgaggcagagtatattcagcgcctccagactgtgcatcacaatgcagatgtctatcaggctgtgtctaagcgaatgcagcaggagggcttccgccgcaccgaacgtcagtgccgctccaagtttaaagttctgaaggcattatatttaaaggcctatgttgcccatgccacaagtatgggtgagccaccacactgtccattttatgatacgttggatcagcttctccgaaatcagatagtgactgacccagacaacttaatggaggatgctgcttgggccaagcactgtgatcagaacttagtggcctctgacgccccaggggaagagggaaccggcattctaaaatcaaaaaggactcaggcagctgatcatcagcctatcttgaaaacagttaaggcatcagatgaggattgtcagctaagaatcagtgaccggatacgagaaaccagtgaccttgaggactcctgggatgaatcctcgggtgcagggtgctctcaagggacccccagctacagcagctcccacagccttttcagaggtgcagttgctccctgtcagagcagccccatggccagactgggtgtgtccggggagcccagcccctgcaccagcaccaaccgcagcactcctggggtagcctccacaccgcagactccagtctcctcttcgagagctggttttgtttctggtggggataggcccttgaccagtgagccccctccaaggtgggcaaggcgaagaaggcggtcagtggccaggactatcgcagccgagttggcagaaaacaggcgattggcacgagaactctcaaagcgggaggaagaaaaactggacaggctgattgctattggtgaggaggccagtgctcagcaagatactgccaatgagctccgcagggatgctgtcatcgcagtcagacgtttggcaacagcagtggaagtggctcattagacgactataagcacaacctgtatttgtaccttaatctcttacatttccactgctgtgtatctgacatatctactagtaagcactgttttgtcaaaccgtctttctctccttcattttactggttcttagtctcctatcaatataaggaaataagaagtgccagggagccgccattgtgtgttacggtttatatcgataatcttcaatataaaatactggccattttataaaatattaaatatatgtaaattctttgcatttcatattatttgggtccctttatatgcctaaattacatctttaagtttcggttgccattggaacattgtggaaacaattcagattatatcagtttcccatccgctttttagctgatttcattcttttctgttatttttttgtctagtatgttatacagggcaagccctagaaacgtttccttttgaggagctttccaagattccttttcctcagatgttgtagacagaagtttatgtagttaatggcatctggtggaagagaacagctttgtttcctctttaactttgggaacactagaggatggtgtggataaagattgcctgcaatagatgactccttttaagcactagccgtgaacagatgagcctcctccacaccccagacacacactggggagagatgaaggtgataagccacacttccgatttactctagaagggaagacattactctctgtcattaaactaacttaaagcttttagtgatttacttagtacttttaggaatacaaataggaatctttaggatttaaaaagttttccaataatctagaagttggaaaaataacaaagagtgggcatgttgggggaggttttattttctatcttgcaggctcgagtgcttagctaaatgctggaaatggacataggtggagaaatggtcagagcagcagtgggagcgtacccagaaccatgagtagacggcaagcgagctgctctgccaagccagggatggaggtgtgaggcggctggtgtggtagaatatgttggaatctagttagaattcctggattggaatcctgtcacagtttgtttcatcagacaaatcacttgcccttttctattattattatttttttttttttgagaaaaagtctcactgttttgcccaggctggggtgcagtggtgcaatcttggctcactgcaacctcagcctcccgagtagccgggattacaggtgcatgccaacatgcccaactcatttttgtatttttagtagagacggggtttcaccatgttggccaggctagtcttgaactcctgacctcaggtgatccacctgcctcggcctcccaaagtgctgagattacaggcgtgagccaccgtgcccagccaattcatgcctcaatttctttatctccggattgagggatttgtattagattttttttttcctagtaccttccagctctaaaaaaatttgaaatagcataataaaagacaaaatgaaaacgaaattttaattgtaatattttctgtcacagcagcatatgtatatttgaaatactggtaacaattttaaggtagcattctgtggtattaatatttattaatatgctcatgaacttctaagtgccacaccagacatatagactctttactttaaaagagcatatatttaaggcattgaaatggatacagctatattcattctcaattgtcttaggctattatatggaaagatatgtgtcaattataggtaggtaggtaggtaggtagattttctggaaacacagaagtacttgacggagagttaggcctgtattctataaatctattaatggtagcaaagtgcataagacagggatttctttgagatgaaaggagtgctgaagaagagcattggaattaatatttggatgtggtattgtgaaattcaatgggtaaagtaaccctaatgtgggaataaaagtcaagggaaaggtcttgaataagtacacagaaaaataggctaaaaatattaaggggagggaaattggaatacagggagacagtgtgcaagaaagcaagccaggaatctgcctatgtggtagacccaaccattactacttgaacccccttagaaaagcttttccagcattccataactcaggttcctcatttataaagtgggaaactcataattgtcctacctacctcacaggggtgttgtgaggatcaaaggaacagatgaatgtatgagcactttcagacatgtaaggcactgtcatgtaacaagtaggggaaagactctggagcacattagtgctggtgtgtgccaagcccgtgggctgttgaccgtaagggatattcaagtaggaggaggaagagaagatggcattgctaataaaggttgtgatacacaaccataggattaactgcctcctcaagtccatcatgtaaataaggtgctatgtataccaacttctcaccacctttgtttttctgttcggtaatcctggtgtggacaaataaagttttcacttgtatgtagttgtgggtcagtccactactt

SEQ ID NO: 349556 - DNA, 3117 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagccagaaatgcggtccttggacctggcttctcacttctccgaaatcagatagtgactgacccagacaacttaatggaggatgctgcttgggccaagcactgtgatcagaacttagtggcctctgacgccccaggggaagagggaaccggcattctaaaatcaaaaaggactcaggcagctgatcatcagcctatcttgaaaacagttaaggcatcagatgaggattgtcagctaagaatcagtgaccggatacgagaaaccagtgaccttgaggactcctgggatgaatcctcgggtgcagggtgctctcaagggacccccagctacagcagctcccacagccttttcagaggtgcagttgctccctgtcagagcagccccatggccagactgggtgtgtccggggagcccagcccctgcaccagcaccaaccgcagcactcctggggtagcctccacaccgcagactccagtctcctcttcgagagctggttttgtttctggtggggataggcccttgaccagtgagccccctccaaggtgggcaaggcgaagaaggcggtcagtggccaggactatcgcagccgagttggcagaaaacaggcgattggcacgagaactctcaaagcgggaggaagaaaaactggacaggctgattgctattggtgaggaggccagtgctcagcaagatactgccaatgagctccgcagggatgctgtcatcgcagtcagacgtttggcaacagcagtggaagaggcaactggtgcttttcagctaggccttgaaaaattgcttcagaggttgatttcgaataccaaaagctaggaaccaattacaaaaggctctgcttcctaaactggtagaagtctagttcccaaacctgccttctgaatccctggctccttttctgtgtcctcagaaaaaaacatggatgaaccatttatatccagatagtatgaaaataattgctagttcattttcccaagattctccaccaaatggaagacctttcagaaatgccaggggtgacctaatagaaaacgatggagccacgttctagacagctggttcatcctagctttgtcacagatgtgaagcagtttacctccctccagtggtttcctcatccgtaaaatggggatcaataataactcctgccctgcctacctcacagggttgttgtgaggatcacgtagttcatagatgtgaaagggtttaaaagtttaaaagcactgtacacatttaagttattaattcatatggccttggctgaggtaaggcagattggtttacaagatacagaagtatggatatatactgtgacttcattgcttgaatctttcctttgctggtctaacttgactgcttcatggagtttgaaatcttaatttttaaaatccctgtgtggctcattagacgactataagcacaacctgtatttgtaccttaatctcttacatttccactgctgtgtatctgacatatctactagtaagcactgttttgtcaaaccgtctttctctccttcattttactggttcttagtctcctatcaatataaggaaataagaagtgccagggagccgccattgtgtgttacggtttatatcgataatcttcaatataaaatactggccattttataaaatattaaatatatgtaaattctttgcatttcatattatttgggtccctttatatgcctaaattacatctttaagtttcggttgccattggaacattgtggaaacaattcagattatatcagtttcccatccgctttttagctgatttcattcttttctgttatttttttgtctagtatgttatacagggcaagccctagaaacgtttccttttgaggagctttccaagattccttttcctcagatgttgtagacagaagtttatgtagttaatggcatctggtggaagagaacagctttgtttcctctttaactttgggaacactagaggatggtgtggataaagattgcctgcaatagatgactccttttaagcactagccgtgaacagatgagcctcctccacaccccagacacacactggggagagatgaaggtgataagccacacttccgatttactctagaagggaagacattactctctgtcattaaactaacttaaagcttttagtgatttacttagtacttttaggaatacaaataggaatctttaggatttaaaaagttttccaataatctagaagttggaaaaataacaaagagtgggcatgttgggggaggttttattttctatcttgcaggctcgagtgcttagctaaatgctggaaatggacataggtggagaaatggtcagagcagcagtgggagcgtacccagaaccatgagtagacggcaagcgagctgctctgccaagccagggatggaggtgtgaggcggctggtgtggtagaatatgttggaatctagttagaattcctggattggaatcctgtcacagtttgtttcatcagacaaatcacttgcccttttctattattattatttttttttttttgagaaaaagtctcactgttttgcccaggctggggtgcagtggtgcaatcttggctcactgcaactccagcctggcaacagagtgagactctgtctcaaaaaaaaaaaa

SEQ ID NO: 349557 - DNA, 1863 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaa

SEQ ID NO: 349558 - DNA, 1772 bp, Homo sapiens
gtcgatttgtgaccattagcagggctgttgtgctatgcgaaaagcagatgaagtggttgtcttggttgtagctggacccgtgccccacactggtctgtcactcttgaagccctgtgtgaatcggcactgtccatgcgcaataatggcatttccgaatcatctgcgtccgtcctgctggccagtagcgtaccatgcatctctggagcgcttctcgcgtggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaaaaaaaaaaagaaagacaaacacacaaacatcaaacaacctacacaaccaagaccgaacaagacaagaaaaaaaaaacaaagcgggggggcgcgcgcaaaatatcatccccgcggggcgggggccaaacttctcacgcggcagcccgccccaacccctcccccaacaagagagggccacaagagggagggagcagcgtataccgcgccggcgcgcggggcgccgtacaaacacagctgcgggggggacaacaacacagacccgtcgcggttcttctgaagggagcacacccccttcttgttggggtggagcaaatatggagcccaacacccctaaggaatatatacggcgctccgaggaaatactagcacgagtgtttataggttaaacaccacacgtatctagacgtaaaaagtgactacacacctcttacgaaattcatacagacaccgcaaatacggcggacacaaacgacgcaccgtagtggaagcacaaccaacacaagcaacacatgt

SEQ ID NO: 349559 - DNA, 1192 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaaggatacttatgcactaagccaaaaactatagttgtttggagagaattcaatattcagtgacaataaatacatccccatatccttttacctattgataaaacttagtaccgagcatattaaatataagttggtgtcaaatattttcagatcataaagtctagaaaaaagaatcgtagatgggtcttcaagcccaaatcactgagcagccaacaatatgatttttttaattaaactttttatttagagagaattgcagtttcccatgctgctgtgtaagaaataatacagagacatcaaacacattgctggattcaccacctctccccgtggttatatcttgcaaaattatagtacagtgtcacaaccaagatgctcacatcgatatagtccagatacagaacatttccatagatctctcccctggtagccaacaatatgttactgtttgttttatgctgctgtttgagggcacatggttagagtaattatgtggctttcttctgccatattgtgcaaaaaaaaaatttgtattagcagagcaacttaaactcacttttctggcccacactgacagtcagatgggtaacacagagccacagcgtgctgtgattagtaaagactgagcatctttcagattgctataccgtggtcatgcttggactcctttagcgttagctgcctcatggtccaggtgattttccctcccagcccatctactcaccaga

SEQ ID NO: 349560 - DNA, 982 bp, Homo sapiens
aagaaacattaaaaacctacagaggtttttatcagtgaattacattttttgcccccagaattactatattttacaaagaaaagtatatctcaagtcatttgcatcttgaatattttaggaactctttattttggctatcatcaacctaagaaactgatctgtgctcatttgagatgtaatttatcaatttctagtataattttctaaggtttatgtaactgttactgtttgccctatgaaagggtaagtttctttattgctgcagaaaatctgtaagaaaaaaatgtactaattaaattcagctattgccattttcctaaccacaagctatccatatcactatgtattacaagtaaatcctttccaaatgaaacttaaaagacaacttactccataaacgatacttagcaagaatatagaattcatcagggtgagtttgccttggcctaggcttgaaaatagcatggtgcatctggagcttatataaagtcttaaacctaagatgtttgtcatcatgggttttcaagaaatacaaccatgatcttagtggtctggaaggaagttcctaataacaactagctaaatataacatatgacacttactaaatttagagacactgagattgtgtttattctttacattaatacccttcttttgaaaattaaaattaacccttgtttactgaaagccctcaagtaacttgttacagactttatgtttttataaaatgagcttgtgcaatgttctttatttttttgtctgtttagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaa

SEQ ID NO: 349561 - DNA, 172 bp, Homo sapiens
tgttgatttgaaactttgcatttttattaaaaattatttatttagcataattgtaatttattttataggtcattgaaaaaaatgggaaattacgatatgaaatagatactggagaagaaacaaaatttgttaacccagaagatgttgccagactgatatttagtaaaatgaa

SEQ ID NO: 349562 - DNA, 548 bp, Homo sapiens
aatcaaaaaggactcaggcagctgatcatcagcctatcttgaaaacagttaaggcatcagatgaggattgtcagctaagaatcagtgaccggatacgagaaaccagtgaccttgaggactcctgggatgaatcctcgggtgcaggtaactcccaagcatgtgaaggagttgggtcccagagtcttgtggctctaaacatttagctgtgtctgtttggatagtgtcctcttcagcatagttcctgtttctgcctcattctgccccacgcaccttttcaaaaacctaatagtaagctaaagggttccaggttttcaaaagctatgcccctggcaacataaggtattagaaccctttaaacctagaagtgctctctagaaccaaactagttctggcattattaataactggtagtcaggaaattgtaggtctagagtgggttggatagctatgtacaaaggggttcaggaaggcaagggagaagttttagaggtgaaatcaaacaggtcacaattgtccagattaaggaaatggattcttcccagtccctg

SEQ ID NO: 349563 - DNA, 1875 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgt

SEQ ID NO: 349564 - DNA, 4419 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagccagaaatgcggtccttggacctggcttctcacttctccgaaatcagatagtgactgacccagacaacttaatggaggatgctgcttgggccaagcactgtgatcagaacttagtggcctctgacgccccaggggaagagggaaccggcattctaaaatcaaaaaggactcaggcagctgatcatcagcctatcttgaaaacagttaaggcatcagatgaggattgtcagctaagaatcagtgaccggatacgagaaaccagtgaccttgaggactcctgggatgaatcctcgggtgcagggtgctctcaagggacccccagctacagcagctcccacagccttttcagaggtgcagttgctccctgtcagagcagccccatggccagactgggtgtgtccggggagcccagcccctgcaccagcaccaaccgcagcactcctggggtagcctccacaccgcagactccagtctcctcttcgagagctggttttgtttctggtggggataggcccttgaccagtgagccccctccaaggtgggcaaggcgaagaaggcggtcagtggccaggactatcgcagccgagttggcagaaaacaggcgattggcacgagaactctcaaagcgggaggaagaaaaactggacaggctgattgctattggtgaggaggccagtgctcagcaagatactgccaatgagctccgcagggatgctgtcatcgcagtcagacgtttggcaacagcagtggaagaggcaactggtgcttttcagctaggccttgaaaaattgcttcagaggttgatttcgaataccaaaagctaggaaccaattacaaaaggctctgcttcctaaactggtagaagtctagttcccaaacctgccttctgaatccctggctccttttctgtgtcctcagaaaaaaacatggatgaaccatttatatccagatagtatgaaaataattgctagttcattttcccaagattctccaccaaatggaagacctttcagaaatgccaggggtgacctaatagaaaacgatggagccacgttctagacagctggttcatcctagctttgtcacagatgtgaagcagtttacctccctccagtggtttcctcatccgtaaaatggggatcaataataactcctgccctgcctacctcacagggttgttgtgaggatcacgtagttcatagatgtgaaagggtttaaaagtttaaaagcactgtacacatttaagttattaattcatatggccttggctgaggtaaggcagattggtttacaagatacagaagtatggatatatactgtgacttcattgcttgaatctttcctttgctggtctaacttgactgcttcatggagtttgaaatcttaatttttaaaatccctgtgtggctcattagacgactataagcacaacctgtatttgtaccttaatctcttacatttccactgctgtgtatctgacatatctactagtaagcactgttttgtcaaaccgtctttctctccttcattttactggttcttagtctcctatcaatataaggaaataagaagtgccagggagccgccattgtgtgttacggtttatatcgataatcttcaatataaaatactggccattttataaaatattaaatatatgtaaattctttgcatttcatattatttgggtccctttatatgcctaaattacatctttaagtttcggttgccattggaacattgtggaaacaattcagattatatcagtttcccatccgctttttagctgatttcattcttttctgttatttttttgtctagtatgttatacagggcaagccctagaaacgtttccttttgaggagctttccaagattccttttcctcagatgttgtagacagaagtttatgtagttaatggcatctggtggaagagaacagctttgtttcctctttaactttgggaacactagaggatggtgtggataaagattgcctgcaatagatgactccttttaagcactagccgtgaacagatgagcctcctccacaccccagacacacactggggagagatgaaggtgataagccacacttccgatttactctagaagggaagacattactctctgtcattaaactaacttaaagcttttagtgatttacttagtacttttaggaatacaaataggaatctttaggatttaaaaagttttccaataatctagaagttggaaaaataacaaagagtgggcatgttgggggaggttttattttctatcttgcaggctcgagtgcttagctaaatgctggaaatggacataggtggagaaatggtcagagcagcagtgggagcgtacccagaaccatgagtagacggcaagcgagctgctctgccaagccagggatggaggtgtgaggcggctggtgtggtagaatatgttggaatctagttagaattcctggattggaatcctgtcacagtttgtttcatcagacaaatcacttgcccttttctattattattatttttttttttttgagaaaaagtctcactgttttgcccaggctggggtgcagtggtgcaatcttggctcactgcaacctcagcctcccgagtagccgggattacaggtgcatgccaacatgcccaactcatttttgtatttttagtagagacggggtttcaccatgttggccaggctagtcttgaactcctgacctcaggtgatccacctgcctcggcctcccaaagtgctgagattacaggcgtgagccaccgtgcccagccaattcatgcctcaatttctttatctccggattgagggatttgtattagattttttttttcctagtaccttccagctctaaaaaaatttgaaatagcataataaaagacaaaatgaaaacgaaattttaattgtaatattttctgtcacagcagcatatgtatatttgaaatactggtaacaattttaaggtagcattctgtggtattaatatttattaatatgctcatgaacttctaagtgccacaccagacatatagactctttactttaaaagagcatatatttaaggcattgaaatggatacagctatattcattctcaattgtcttaggctattatatggaaagatatgtgtcaattataggtaggtaggtaggtaggtagattttctggaaacacagaagtacttgacggagagttaggcctgtattctataaatctattaatggtagcaaagtgcataagacagggatttctttgagatgaaaggagtgctgaagaagagcattggaattaatatttggatgtggtattgtgaaattcaatgggtaaagtaaccctaatgtgggaataaaagtcaagggaaaggtcttgaataagtacacagaaaaataggctaaaaatattaaggggagggaaattggaatacagggagacagtgtgcaagaaagcaagccaggaatctgcctatgtggtagacccaaccattactacttgaacccccttagaaaagcttttccagcattccataactcaggttcctcatttataaagtgggaaactcataattgtcctacctacctcacaggggtgttgtgaggatcaaaggaacagatgaatgtatgagcactttcagacatgtaaggcactgtcatgtaacaagtaggggaaagactctggagcacattagtgctggtgtgtgccaagcccgtgggctgttgaccgtaagggatattcaagtaggaggaggaagagaagatggcattgctaataaaggttgtgatacacaaccataggattaactgcctcctcaagtccatcatgtaaataaggtgctatgtataccaacttctcaccacctttgtttttctgttcggtaatcctggtgtggacaaataaagttttcacttgtatgtagttgtgggtcagtccactactt

SEQ ID NO: 349565 - DNA, 4932 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaaggatacttatgcactaagccaaaaactatagttgtttggagagaattcaatattcagtgacaataaatacatccccatctcattcccctgtggccttccagccagaaatgcggtccttggacctggcttctcagcaattatccctgagagggaagatcctggagatatcctgagagcacacagagcttccccacaccttcagacttgcaccttgctgtccagaagctgcctagccctcctttccaacccacaatggccagtgccaatagcagtgcgggcatccggtggtccagacaggagacacgaactcttctctccatactaggcgaggcagagtatattcagcgcctccagactgtgcatcacaatgcagatgtctatcaggctgtgtctaagcgaatgcagcaggagggcttccgccgcaccgaacgtcagtgccgctccaagtttaaagttctgaaggcattatatttaaaggcctatgttgcccatgccacaagtatgggtgagccaccacactgtccattttatgatacgttggatcagcttctccgaaatcagatagtgactgacccagacaacttaatggaggatgctgcttgggccaagcactgtgatcagaacttagtggcctctgacgccccaggggaagagggaaccggcattctaaaatcaaaaaggactcaggcagctgatcatcagcctatcttgaaaacagttaaggcatcagatgaggattgtcagctaagaatcagtgaccggatacgagaaaccagtgaccttgaggactcctgggatgaatcctcgggtgcagggtgctctcaagggacccccagctacagcagctcccacagccttttcagaggtgcagttgctccctgtcagagcagccccatggccagactgggtgtgtccggggagcccagcccctgcaccagcaccaaccgcagcactcctggggtagcctccacaccgcagactccagtctcctcttcgagagctggttttgtttctggtggggataggcccttgaccagtgagccccctccaaggtgggcaaggcgaagaaggcggtcagtggccaggactatcgcagccgagttggcagaaaacaggcgattggcacgagaactctcaaagcgggaggaagaaaaactggacaggctgattgctattggtgaggaggccagtgctcagcaagatactgccaatgagctccgcagggatgctgtcatcgcagtcagacgtttggcaacagcagtggaagaggcaactggtgcttttcagctaggccttgaaaaattgcttcagaggttgatttcgaataccaaaagctaggaaccaattacaaaaggctctgcttcctaaactggtagaagtctagttcccaaacctgccttctgaatccctggctccttttctgtgtcctcagaaaaaaacatggatgaaccatttatatccagatagtatgaaaataattgctagttcattttcccaagattctccaccaaatggaagacctttcagaaatgccaggggtgacctaatagaaaacgatggagccacgttctagacagctggttcatcctagctttgtcacagatgtgaagcagtttacctccctccagtggtttcctcatccgtaaaatggggatcaataataactcctgccctgcctacctcacagggttgttgtgaggatcacgtagttcatagatgtgaaagggtttaaaagtttaaaagcactgtacacatttaagttattaattcatatggccttggctgaggtaaggcagattggtttacaagatacagaagtatggatatatactgtgacttcattgcttgaatctttcctttgctggtctaacttgactgcttcatggagtttgaaatcttaatttttaaaatccctgtgtggctcattagacgactataagcacaacctgtatttgtaccttaatctcttacatttccactgctgtgtatctgacatatctactagtaagcactgttttgtcaaaccgtctttctctccttcattttactggttcttagtctcctatcaatataaggaaataagaagtgccagggagccgccattgtgtgttacggtttatatcgataatcttcaatataaaatactggccattttataaaatattaaatatatgtaaattctttgcatttcatattatttgggtccctttatatgcctaaattacatctttaagtttcggttgccattggaacattgtggaaacaattcagattatatcagtttcccatccgctttttagctgatttcattcttttctgttatttttttgtctagtatgttatacagggcaagccctagaaacgtttccttttgaggagctttccaagattccttttcctcagatgttgtagacagaagtttatgtagttaatggcatctggtggaagagaacagctttgtttcctctttaactttgggaacactagaggatggtgtggataaagattgcctgcaatagatgactccttttaagcactagccgtgaacagatgagcctcctccacaccccagacacacactggggagagatgaaggtgataagccacacttccgatttactctagaagggaagacattactctctgtcattaaactaacttaaagcttttagtgatttacttagtacttttaggaatacaaataggaatctttaggatttaaaaagttttccaataatctagaagttggaaaaataacaaagagtgggcatgttgggggaggttttattttctatcttgcaggctcgagtgcttagctaaatgctggaaatggacataggtggagaaatggtcagagcagcagtgggagcgtacccagaaccatgagtagacggcaagcgagctgctctgccaagccagggatggaggtgtgaggcggctggtgtggtagaatatgttggaatctagttagaattcctggattggaatcctgtcacagtttgtttcatcagacaaatcacttgcccttttctattattattatttttttttttttgagaaaaagtctcactgttttgcccaggctggggtgcagtggtgcaatcttggctcactgcaacctcagcctcccgagtagccgggattacaggtgcatgccaacatgcccaactcatttttgtatttttagtagagacggggtttcaccatgttggccaggctagtcttgaactcctgacctcaggtgatccacctgcctcggcctcccaaagtgctgagattacaggcgtgagccaccgtgcccagccaattcatgcctcaatttctttatctccggattgagggatttgtattagattttttttttcctagtaccttccagctctaaaaaaatttgaaatagcataataaaagacaaaatgaaaacgaaattttaattgtaatattttctgtcacagcagcatatgtatatttgaaatactggtaacaattttaaggtagcattctgtggtattaatatttattaatatgctcatgaacttctaagtgccacaccagacatatagactctttactttaaaagagcatatatttaaggcattgaaatggatacagctatattcattctcaattgtcttaggctattatatggaaagatatgtgtcaattataggtaggtaggtaggtaggtagattttctggaaacacagaagtacttgacggagagttaggcctgtattctataaatctattaatggtagcaaagtgcataagacagggatttctttgagatgaaaggagtgctgaagaagagcattggaattaatatttggatgtggtattgtgaaattcaatgggtaaagtaaccctaatgtgggaataaaagtcaagggaaaggtcttgaataagtacacagaaaaataggctaaaaatattaaggggagggaaattggaatacagggagacagtgtgcaagaaagcaagccaggaatctgcctatgtggtagacccaaccattactacttgaacccccttagaaaagcttttccagcattccataactcaggttcctcatttataaagtgggaaactcataattgtcctacctacctcacaggggtgttgtgaggatcaaaggaacagatgaatgtatgagcactttcagacatgtaaggcactgtcatgtaacaagtaggggaaagactctggagcacattagtgctggtgtgtgccaagcccgtgggctgttgaccgtaagggatattcaagtaggaggaggaagagaagatggcattgctaataaaggttgtgatacacaaccataggattaactgcctcctcaagtccatcatgtaaataaggtgctatgtataccaacttctcaccacctttgtttttctgttcggtaatcctggtgtggacaaataaagttttcacttgtatgtagttgtgggtcagtccactactt

SEQ ID NO: 349566 - DNA, 2425 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaaaaaaaaaaagaaagacaaacacacaaacatcaaacaacctacacaaccaagaccgaacaagacaagaaaaaaaaaacaaagcgggggggcgcgcgcaaaatatcatccccgcggggcgggggccaaacttctcacgcggcagcccgccccaacccctcccccaacaagagagggccacaagagggagggagcagcgtataccgcgccggcgcgcggggcgccgtacaaacacagctgcgggggggacaacaacacagacccgtcgcggttcttctgaagggagcacacccccttcttgttggggtggagcaaatatggagcccaacacccctaaggaatatatacggcgctccgaggaaatactagcacgagtgtttataggttaaacaccacacgtatctagacgtaaaaagtgactacacacctcttacgaaattcatacagacaccgcaaatacggcggacacaaacgacgcaccgtagtggaagcacaaccaacacaagcaacacatgt

SEQ ID NO: 349567 - DNA, 2375 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaagaaacggcacattctgtattgggctcagatgcaaatgatgtagttattactgtcccgtttgattttggagaaaagcaaaaaaatgctcttggagaagcagctagagctgctggatttaatgttttgcgattaattcacgaaccgtctgcagctcttcttgcttatggaattggacaagactcccctactggaaaaagtggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaaaaaaaaaaagaaagacaaacacacaaacatcaaacaacctacacaaccaagaccgaacaagacaagaaaaaaaaaacaaagcgggggggcgcgcgcaaaatatcatccccgcggggcgggggccaaacttctcacgcggcagcccgccccaacccctcccccaacaagagagggccacaagagggagggagcagcgtataccgcgccggcgcgcggggcgccgtacaaacacagctgcgggggggacaacaacacagacccgtcgcggttcttctgaagggagcacacccccttcttgttggggtggagcaaatatggagcccaacacccctaaggaatatatacggcgctccgaggaaatactagcacgagtgtttataggttaaacaccacacgtatctagacgtaaaaagtgactacacacctcttacgaaattcatacagacaccgcaaatacggcggacacaaacgacgcaccgtagtggaagcacaaccaacacaagcaacacatgt

SEQ ID NO: 349568 - DNA, 1973 bp, Homo sapiens
tatttctcttattcagtacgtgtgctttttgctttctttgtgaagaatatgggctctgaacattacaattttaaacagaaagtgatctcttatagtcattcatttcttgttttctatattcttgcttctaaagatcattatacttcatgttctacttatgaaattttagtagcttttgtataaaatctttagcagatcatttctaaaaatgtagaattgaacatgtgataaattaaattcattgaaagcaaattgttcacagagaagcagctagagctgctggatttaatgttttgcgattaattcacgaaccgtctgcagctcttcttgcttatggaattggacaagactcccctactggaaaaagcaatattttggtgtttaagcttggaggaacatccttatctctcagcgtcatggaagttaacagtggaatatatcgggttctttcaacaaacactgatgataacatcggtggtgcacatttcacagaaaccttagcacagtatctagcttctgagttccaaagatccttcaaacatgatgtgagaggaaatgcgcgagccatgatgaaattaacgaacagtgctgaagtagcgaaacattctttgtcaaccttgggaagtgccaactgttttcttgactcattatatgaaggtcaagattttgattgcaatgtgtccagagcaagatttgaacttctttgttctccactttttaataagtgtatagaagcaatcagaggactcttagatcaaaatggatttacagcagatgatatcaacaaggttgtcctttgtggagggtcttctcgaatcccaaagctacagcaactgattaaagatcttttcccagctgttgagcttctcaattctatccctcctgatgaagtgatccctattggtgcagctatagaagcaggaattcttattgggaaagaaaacctgttggtggaagactctcttatgatagagtgttcagccagagatattttagttaagggtgtggacgaatcaggagccagtagattcacagtgctgtttccatcagggactcctttgccagctcgaagacaacacacattgcaagcccctggaagcatatcttcagtgtgccttgaactctatgagtctgatgggaagaactctgccaaagaggaaaccaagtttgcacaggttgtactccaggatttagataaaaaagaaaatggattacgtgatatattagctgttcttactatgaaaagggatggatctttacatgtgacatgcacagatcaagaaactggaaaatgtgaagcaatctctattgagatagcatcttagtgttttagagaaatcaagaatttttaaaaacaagaatatcaacatttggttttgtgtataagtggtgtttgtattaaaatactttttcaatgaactgtataaactatgttttattaaactacaatatatcagtaaaaaaaaaaagaaagacaaacacacaaacatcaaacaacctacacaaccaagaccgaacaagacaagaaaaaaaaaacaaagcgggggggcgcgcgcaaaatatcatccccgcggggcgggggccaaacttctcacgcggcagcccgccccaacccctcccccaacaagagagggccacaagagggagggagcagcgtataccgcgccggcgcgcggggcgccgtacaaacacagctgcgggggggacaacaacacagacccgtcgcggttcttctgaagggagcacacccccttcttgttggggtggagcaaatatggagcccaacacccctaaggaatatatacggcgctccgaggaaatactagcacgagtgtttataggttaaacaccacacgtatctagacgtaaaaagtgactacacacctcttacgaaattcatacagacaccgcaaatacggcggacacaaacgacgcaccgtagtggaagcacaaccaacacaagcaacacatgt

SEQ ID NO: 349569 - DNA, 859 bp, Homo sapiens
cgcgtgcgcactgtgcagtttccgcggagcggcagagacgcgctgaagctactcgcggactgcgcgtgaagaaaggcggaaccttcacgctgattggcggcgacgcgggaggctgtagcggccgaccggacgcagggggctggcgggaacgtgaagctccgcggtgcctgatggggccgttgggcggccggtagctgttgctgttgggggaccccctcattcctgccgctgccgtccctgctgcctcatggcggccatcggagttcacctgggctgcacctcagcctgtgtggccgtctataaggatggccgggctggtgtggttgcaaatgatgccggtgaccgagttactccagctgttgttgcttactcagaaaatgaagagattgttggattggcagcaaaacaaagtagaataagaaatatttcaaatacagtaatgaaagtaaagcagatcctgggcagaagctccagtgatccacaagctcagaaatacatcgcggaaagtaaatgtttagtcattgaaaaaaatgggaaattacgatatgaaatagatactggagaagaaacaaaatttgttaacccagaagatgttgccagactgatatttagtaaaatgaaaggagcttattctccatggagtcagtctaattcagaagatggttgatactgaagcctaagagccaggctgtttggaaagctaattctgtgtccaaatatatcaccaaaaccacaagaagtgctgcatgatttcagagcgcagagaagaaaattgacacgggggcggggtgggcaagcaagtgtattgggaaatatgttaagtgagatctttgtcataaattaataaacctcagaaagt

SEQ ID NO: 349570 - DNA, 370 bp, Homo sapiens
ccctgacgtttcctaaatactggcctggcctgtgccgcccctgcccccactactcacaagtttctgagccctttgtcagttttgtacattcccaagcatgccagcttctgtgcccatggaccttgctgcatcctgcacagcagggttcagtttcatgtatctttgtcttttcctctagaacctgcctttttcaaatatccctgccttttcccacctggaaacatatactgtatgcgaaagagttgatatatgcaaagtaattcaaacctggccatgtactttggaaaagaaagcatagagatgaattgtgggtgtttctcacaccttaacgaaaatctcgtgcgatctgattccagaagattcttgtgag

SEQ ID NO: 349571 - DNA, 386 bp, Homo sapiens
aagtgctgggattacaggcgtgagccaccacgtctggccaaacctagtttttagctattttattaaatggaattatagactagtaggaccgtcacagtcttgattactttaagaccagatcatgcaagtgtttttgactattctgcaggaaatgaaatcaaaccacttctacctattttctcctgttatagtttttatcctgagtctggaagttatgttaaatatttttttgcactaaattccaataaagcagagaaaagacaattgttaggcaatttgtagtaccagcattgtttttctatacatactgttataggtgaagcatttaaattattgtgcttttttggtaacaagttttttacattttaaagttgttctttatattt

SEQ ID NO: 349572 - DNA, 430 bp, Homo sapiens
aaatgccagggatgctcactggcaaaatatcacatttgacattttccatctgaagtttcaggctctcctgttctcaacctgagtagtttcaaaaggtctgtggaccactgaaagaacacggtattcgggaaacttccgcaaggacaggaagaaatcaaacactcagaacacaaagccattaaaaccccacagatggactccaaaatatatgtcacaagcaaatagctgcgggaaagggtgagatgcagacagaagctgaaaataagggcttagctgaagatgctaggtaaactgtatgttttgattattcatgctgcctagctactataaatgattgggtcaatcattcctgttggatgaagatatctttatatcaactctaagatcatttgaagaaaaagtgaaaacagcttaaagttccaaaatgtaa

SEQ ID NO: 349573 - DNA, 4283 bp, Homo sapiens
tctctcctgcctcctctggccttcggactcctgcccgcgccgcccgcagccccctcccggccctgcagcccctgggcgggcggcgcccctcggaggacggctccgggcccggggggacggagggcctggtcgcctggaggaagccggaggcctgcgtggaggaggcgccccgcgcagctggctggcggagcatgagcgccccagatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgctatatcaaccctgccaagctcacgccctacctgcgtcagtgtaaggtcattgatgagcaggatgaagatgaagtgcttaatgcccctatgctgccatccaagatcaaccgagcaggccggctgttggacattctacataccaaggggcaaaggggctatgtggtcttcttggagagcctagaattttattacccagaactgtacaaactggtgactgggaaagagcccactcggagattctccaccattgtggtggaggaaggccacgagggcctcacgcacttcctgatgaacgaggtcatcaagctgcagcagcagatgaaggccaaggacctgcaacgctgcgagctgctggccaggttgcggcagctggaggatgagaagaagcagatgacgctgacgcgcgtggagctgctaaccttccaggagcggtactacaagatgaaggaagagcgggacagctacaatgacgagctggtcaaggtgaaggacgacaactacaacttagccatgcgctacgcacagctcagtgaggagaagaacatggcggtcatgaggagccgagacctccaactcgagatcgatcagctaaagcaccggttgaataagatggaggaggaatgtaagctggagagaaatcagtctctaaaactgaagaatgacattgaaaatcggcccaagaaggagcaggttctggaactggagcgggagaatgaaatgctgaagaccaaaaaccaggagctgcagtccatcatccaggccgggaagcgcagcctgccagactcagacaaggccatcctggacatcttggaacacgaccgcaaggaggccctggaggacaggcaggagctggtcaacaggatctacaacctgcaggaggaggcccgccaggcagaggagctgcgagacaagtacctggaggagaaggaggacctggagctcaagtgctcgaccctgggaaaggactgtgaaatgtacaagcaccgcatgaacacggtcatgctgcagctggaggaggtggagcgggagcgggaccaggccttccactcccgagatgaagctcagacacagtactcgcagtgcttaatcgaaaaggacaagtacaggaagcagatccgcgagctggaggagaagaacgacgagatgaggatcgagatggtgcggcgggaggcctgcatcgtcaacctggagagcaagctgcggcgcctctccaaggacagcaacaacctggaccagagtctgcccaggaacctgccagtaaccatcatctctcaggactttggggatgccagccccaggaccaatggtcaagaagctgacgattcttccacctcggaggagtcacctgaagacagcaagtacttcctgccctaccatccgccccagcgcaggatgaacctgaagggcatccagctgcagagagccaaatcccccatcagcctgaagcgaacatcagattttcaagccaaggggcacgaggaagaaggcacggacgccagccctagctcctgcggatctctgcccatcaccaactccttcaccaagatgcagcccccccggagccgcagcagcatcatgtcaatcaccgccgagcccccgggaaacgactccatcgtcagacgctacaaggaggacgcgccccatcgcagcacagtcgaagaagacaatgacagcggcgggtttgacgccttagatctggatgatgacagtcacgaacgctactccttcggaccctcctccatccactcctcctcctcctcccaccaatccgagggcctggatgcctacgacctggagcaggtcaacctcatgttcaggaagttctctctggaaagacccttccggccttcggtcacctctgtggggcacgtgcggggcccagggccctcggtgcagcacacgacgctgaatggcgacagcctcacctcccagctcaccctgctggggggcaacgcgcgagggagcttcgtgcactcggtcaagcctggctctctggccgagaaagccggcctccgtgagggccaccagctgctgctgctagaaggctgcatccgaggcgagaggcagagtgtcccgttggacacatgcaccaaagaggaagcccactggaccatccagaggtgcagcggccccgtcacgctgcactacaaggtcaaccacgaagggtaccggaagctggtgaaggacatggaggacggcctgatcacatcgggggactcgttctacatccggctgaacctgaacatctccagccagctggacgcctgcaccatgtccctgaagtgtgacgatgttgtgcacgtccgtgacaccatgtaccaggacaggcacgagtggctgtgcgcgcgggtcgaccctttcacagaccatgacctggatatgggcaccatacccagctacagccgagcccagcagctcctcctggtgaaactgcagcgcctgatgcaccgaggcagccgggaggaggtagacggcacccaccacaccctgcgggcactccggaacaccctgcagccggaagaagcgctttcaacaagcgacccccgggtcagcccccgtctctcgcgagcaagcttcctttttggccagctccttcagttcgtcagcaggtccgagaacaagtataagcggatgaacagcaacgagcgggtccgcatcatctcggggagtccgctagggagcctggcccggtcctcgctggacgccaccaagctcttgactgagaagcaggaagagctggaccctgagagcgagctgggcaagaacctcagcctcatcccctacagcctggtacgcgccttctactgcgagcgccgccggcccgtgctcttcacacccaccgtgctggccaagacgctggtgcagaggctgctcaactcgggaggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccggcctgagacggaggaggagttcctgcgcgtgtgccggctgaaggagaaggagctggaggccctgccgtgcctgtacgccacggtggaacctgacatgtggggcagcgtagaggagctgctccgcgttgtcaaggacaagatcggcgaggagcagcgcaagaccatctgggtggacgaggaccagctgtgaggcgggcgccctgggcagagagactctgtggcgcggggcatcctatgaggcaggcaccctgggcagagagatgcagtgggtgcggggggatcctgtggcccacagagctgccccagcagacgctccgccccacccggtgatggagccccggggggacagtcgtgcctggggaggagcagggtacagcccattcccccagccctggctgacctggcctagcagtttggccctgctggccttagcagggagacaggggagcaaagaacgccaagccggaggcccgaggccagccggcctctcgagagccagagcagcagttgaatgtaatgctggggacaggcatgctgccgccagtagggcggggacccggacagccaggtgactaccagtcctggggacacactcaccataaacacatccccaggcaggacagatcggggaaggggtgtgtaccaggctatgatttctcttgcattaaaatgtattatt

SEQ ID NO: 349574 - DNA, 4622 bp, Homo sapiens
tctctcctgcctcctctggccttcggactcctgcccgcgccgcccgcagccccctcccggccctgcagcccctgggcgggcggcgcccctcggaggacggctccgggcccggggggacggagggcctggtcgcctggaggaagccggaggcctgcgtggaggaggcgccccgcgcagctggctggcggagcatgagcgccccagatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgctatatcaaccctgccaagctcacgccctacctgcgtcagtgtaaggtcattgatgagcaggatgaagatgaagtgcttaatgcccctatgctgccatccaagatcaaccgagcaggccggctgttggacattctacataccaaggggcaaaggggctatgtggtcttcttggagagcctagaattttattacccagaactgtacaaactggtgactgggaaagagcccactcggagattctccaccattgtggtggaggaaggccacgagggcctcacgcacttcctgatgaacgaggtcatcaagctgcagcagcagatgaaggccaaggacctgcaacgctgcgagctgctggccaggttgcggcagctggaggatgagaagaagcagatgacgctgacgcgcgtggagctgctaaccttccaggagcggtactacaagatgaaggaagagcgggacagctacaatgacgagctggtcaaggtgaaggacgacaactacaacttagccatgcgctacgcacagctcagtgaggagaagaacatggcggtcatgaggagccgagacctccaactcgagatcgatcagctaaagcaccggttgaataagatggaggaggaatgtaagctggagagaaatcagtctctaaaactgaagaatgacattgaaaatcggcccaagaaggagcaggttctggaactggagcgggagaatgaaatgctgaagaccaaaaaccaggagctgcagtccatcatccaggccgggaagcgcagcctgccagactcagacaaggccatcctggacatcttggaacacgaccgcaaggaggccctggaggacaggcaggagctggtcaacaggatctacaacctgcaggaggaggcccgccaggcagaggagctgcgagacaagtacctggaggagaaggaggacctggagctcaagtgctcgaccctgggaaaggactgtgaaatgtacaagcaccgcatgaacacggtcatgctgcagctggaggaggtggagcgggagcgggaccaggccttccactcccgagatgaagctcagacacagtactcgcagtgcttaatcgaaaaggacaagtacaggaagcagatccgcgagctggaggagaagaacgacgagatgaggatcgagatggtgcggcgggaggcctgcatcgtcaacctggagagcaagctgcggcgcctctccaaggacagcaacaacctggaccagagtctgcccaggaacctgccagtaaccatcatctctcaggactttggggatgccagccccaggaccaatggtcaagaagctgacgattcttccacctcggaggagtcacctgaagacagcaagtacttcctgccctaccatccgccccagcgcaggatgaacctgaagggcatccagctgcagagagccaaatcccccatcagcctgaagcgaacatcagattttcaagccaaggggcacgaggaagaaggcacggacgccagccctagctcctgcggatctctgcccatcaccaactccttcaccaagatgcagcccccccggagccgcagcagcatcatgtcaatcaccgccgagcccccgggaaacgactccatcgtcagacgctacaaggaggacgcgccccatcgcagcacagtcgaagaagacaatgacagcggcgggtttgacgccttagatctggatgatgacagtcacgaacgctactccttcggaccctcctccatccactcctcctcctcctcccaccaatccgagggcctggatgcctacgacctggagcaggtcaacctcatgttcaggaagttctctctggaaagacccttccggccttcggtcacctctgtggggcacgtgcggggcccagggccctcggtgcagcacacgacgctgaatggcgacagcctcacctcccagctcaccctgctggggggcaacgcgcgagggagcttcgtgcactcggtcaagcctggctctctggccgagaaagccggcctccgtgagggccaccagctgctgctgctagaaggctgcatccgaggcgagaggcagagtgtcccgttggacacatgcaccaaagaggaagcccactggaccatccagaggtgcagcggccccgtcacgctgcactacaaggtcaaccacgaagggtaccggaagctggtgaaggacatggaggacggcctgatcacatcgggggactcgttctacatccggctgaacctgaacatctccagccagctggacgcctgcaccatgtccctgaagtgtgacgatgttgtgcacgtccgtgacaccatgtaccaggacaggcacgagtggctgtgcgcgcgggtcgaccctttcacagaccatgacctggatatgggcaccatacccagctacagccgagcccagcagctcctcctggtgaaactgcagcgcctgatgcaccgaggcagccgggaggaggtagacggcacccaccacaccctgcgggcactccggaacaccctgcagccggaagaagcgctttcaacaagcgacccccgggtcagcccccgtctctcgcgagcaagcttcctttttggccagctccttcagttcgtcagcaggtccgagaacaagtataagcggatgaacagcaacgagcgggtccgcatcatctcggggagtccgctagggagcctggcccggtcctcgctggacgccaccaagctcttgactgagaagcaggaagagctggaccctgagagcgagctgggcaagaacctcagcctcatcccctacagcctggtacgcgccttctactgcgagcgccgccggcccgtgctcttcacacccaccgtgctggccaagacgctggtgcagaggctgctcaactcgggaggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccggcctgagacggaggaggagttcctgcgcgtgtgccggctgaaggagaaggagctggaggccctgccgtgcctgtacgccacggtggaacctgacatgtggggcagcgtagaggagctgctccgcgttgtcaaggacaagatcggcgaggagcagcgcaagaccatctgggtggacgaggaccagctgtgaggcgggcgccctgggcagagagactctgtggcgcggggcatcctatgaggcaggcaccctgggcagagagatgcagtgggtgcggggggatcctgtggcccacagagctgccccagcagacgctccgccccacccggtgatggagccccggggggacagtcgtgcctggggaggagcagggtacagcccattcccccagccctggctgacctggcctagcagtttggccctgctggccttagcagggagacaggggagcaaagaacgccaagccggaggcccgaggccagccggcctctcgagagccagagcagcagttgaatgtaatgctggggacaggcatgctgccgccagtagggcggggacccggacagccaggtgactaccagtcctggggacacactcaccataaacacatccccaggcaggacagatcggggaaggggtgtgtaccaggctatgatttctcttgcattaaaatgtattattatttctttgtttcgaccctttgtttgtgaacagcttgccaggccttgagcccttgccgccttcctaacctgaaaaccatgcccagtgagcttagctggagactcaggccccatgttcctgggtagggtgaaggtggggtgaccacacaccccagggtcccaggacaggcctgatttacccctgggcttagggtaatacttgctaatcgcaccctatggactcaaatgcatcctgatttggaagatcaataaattatcttgtcaccctgagaagggcccatcctctcactgaccctggggagcccttgcagtctgtgtctggcctgccccgtaactccag

SEQ ID NO: 349575 - DNA, 493 bp, Homo sapiens
tctctcctgcctcctctggccttcggactcctgcccgcgccgcccgcagccccctcccggccctgcagcccctgggcgggcggcgcccctcggaggacggctccgggcccggggggacggagggcctggtcgcctggaggaagccggaggcctgcgtggaggaggcgccccgcgcagctggctggcggagcatgagcgccccagatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgggtctcacgaattccgctgagttctcacgaattccgctgaggtctcacgaattccgctga

SEQ ID NO: 349576 - DNA, 4964 bp, Homo sapiens
tctctcctgcctcctctggccttcggactcctgcccgcgccgcccgcagccccctcccggccctgcagcccctgggcgggcggcgcccctcggaggacggctccgggcccggggggacggagggcctggtcgcctggaggaagccggaggcctgcgtggaggaggcgccccgcgcagctggctggcggagcatgagcgccccagatcccaagcactgcaagtccagatgcaacgggagcctggctcaagggacgacaagatccagccggaaagtgtagaagtcacaccccaatggcgggatagcagcccctgtgtgtgagcacccctccatgccaggaggagggccagagatggatgactacatggagacgctgaaggatgaagaggacgccttgtgggagaatgtggagtgtaaccggcacatgctcagccgctatatcaaccctgccaagctcacgccctacctgcgtcagtgtaaggtcattgatgagcaggatgaagatgaagtgcttaatgcccctatgctgccatccaagatcaaccgagcaggccggctgttggacattctacataccaaggggcaaaggggctatgtggtcttcttggagagcctagaattttattacccagaactgtacaaactggtgactgggaaagagcccactcggagattctccaccattgtggtggaggaaggccacgagggcctcacgcacttcctgatgaacgaggtcatcaagctgcagcagcagatgaaggccaaggacctgcaacgctgcgagctgctggccaggttgcggcagctggaggatgagaagaagcagatgacgctgacgcgcgtggagctgctaaccttccaggagcggtactacaagatgaaggaagagcgggacagctacaatgacgagctggtcaaggtgaaggacgacaactacaacttagccatgcgctacgcacagctcagtgaggagaagaacatggcggtcatgaggagccgagacctccaactcgagatcgatcagctaaagcaccggttgaataagatggaggaggaatgtaagctggagagaaatcagtctctaaaactgaagaatgacattgaaaatcggcccaagaaggagcaggttctggaactggagcgggagaatgaaatgctgaagaccaaaaaccaggagctgcagtccatcatccaggccgggaagcgcagcctgccagactcagacaaggccatcctggacatcttggaacacgaccgcaaggaggccctggaggacaggcaggagctggtcaacaggatctacaacctgcaggaggaggcccgccaggcagaggagctgcgagacaagtacctggaggagaaggaggacctggagctcaagtgctcgaccctgggaaaggactgtgaaatgtacaagcaccgcatgaacacggtcatgctgcagctggaggaggtggagcgggagcgggaccaggccttccactcccgagatgaagctcagacacagtactcgcagtgcttaatcgaaaaggacaagtacaggaagcagatccgcgagctggaggagaagaacgacgagatgaggatcgagatggtgcggcgggaggcctgcatcgtcaacctggagagcaagctgcggcgcctctccaaggacagcaacaacctggaccagagtctgcccaggaacctgccagtaaccatcatctctcaggactttggggatgccagccccaggaccaatggtcaagaagctgacgattcttccacctcggaggagtcacctgaagacagcaagtacttcctgccctaccatccgccccagcgcaggatgaacctgaagggcatccagctgcagagagccaaatcccccatcagcctgaagcgaacatcagattttcaagccaaggggcacgaggaagaaggcacggacgccagccctagctcctgcggatctctgcccatcaccaactccttcaccaagatgcagcccccccggagccgcagcagcatcatgtcaatcaccgccgagcccccgggaaacgactccatcgtcagacgctacaaggaggacgcgccccatcgcagcacagtcgaagaagacaatgacagcggcgggtttgacgccttagatctggatgatgacagtcacgaacgctactccttcggaccctcctccatccactcctcctcctcctcccaccaatccgagggcctggatgcctacgacctggagcaggtcaacctcatgttcaggaagttctctctggaaagacccttccggccttcggtcacctctgtggggcacgtgcggggcccagggccctcggtgcagcacacgacgctgaatggcgacagcctcacctcccagctcaccctgctggggggcaacgcgcgagggagcttcgtgcactcggtcaagcctggctctctggccgagaaagccggcctccgtgagggccaccagctgctgctgctagaaggctgcatccgaggcgagaggcagagtgtcccgttggacacatgcaccaaagaggaagcccactggaccatccagaggtgcagcggccccgtcacgctgcactacaaggtcaaccacgaagggtaccggaagctggtgaaggacatggaggacggcctgatcacatcgggggactcgttctacatccggctgaacctgaacatctccagccagctggacgcctgcaccatgtccctgaagtgtgacgatgttgtgcacgtccgtgacaccatgtaccaggacaggcacgagtggctgtgcgcgcgggtcgaccctttcacagaccatgacctggatatgggcaccatacccagctacagccgcatctatgagaccataacaccacacctcaggccagtcctcgaaggcaagcatcatcacaccagatttacagaggaggagaccgtggctcagaggggttcggccactttgctgcagcctcacagcaagccagtgctggaggtgggatccaaacacagatacaaggagccacatcttctccccgggcgccccctgggctcagagcgcacaccagccacagggccatccctacgcagagtcggacacgcgccccacccatgccagtgcggtgctgcggccccgctggcttcccggtgcttggcccctgaatttcagcctctgaggctcctctcttcgctccccagagcccagcagctcctcctggtgaaactgcagcgcctgatgcaccgaggcagccgggaggaggtagacggcacccaccacaccctgcgggcactccggaacaccctgcagccggaagaagcgctttcaacaagcgacccccgggtcagcccccgtctctcgcgagcaagcttcctttttggccagctccttcagttcgtcagcaggtccgagaacaagtataagcggatgaacagcaacgagcgggtccgcatcatctcggggagtccgctagggagcctggcccggtcctcgctggacgccaccaagctcttgactgagaagcaggaagagctggaccctgagagcgagctgggcaagaacctcagcctcatcccctacagcctggtacgcgccttctactgcgagcgccgccggcccgtgctcttcacacccaccgtgctggccaagacgctggtgcagaggctgctcaactcgggaggtgccatggagttcaccatctgcaagtcagatatcgtcacaagagatgagttcctcagaaggcagaagacggagaccatcatctactcccgagagaagaaccccaacgcgttcgaatgcatcgcccctgccaacattgaagctgtggccgccaagaacaagcactgcctgctggaggctgggatcggctgcacaagagacttgatcaagtccaacatctaccccatcgtgctcttcatccgggtgtgtgagaagaacatcaagaggttcagaaagctgctgccccggcctgagacggaggaggagttcctgcgcgtgtgccggctgaaggagaaggagctggaggccctgccgtgcctgtacgccacggtggaacctgacatgtggggcagcgtagaggagctgctccgcgttgtcaaggacaagatcggcgaggagcagcgcaagaccatctgggtggacgaggaccagctgtgaggcgggcgccctgggcagagagactctgtggcgcggggcatcctatgaggcaggcaccctgggcagagagatgcagtgggtgcggggggatcctgtggcccacagagctgccccagcagacgctccgccccacccggtgatggagccccggggggacagtcgtgcctggggaggagcagggtacagcccattcccccagccctggctgacctggcctagcagtttggccctgctggccttagcagggagacaggggagcaaagaacgccaagccggaggcccgaggccagccggcctctcgagagccagagcagcagttgaatgtaatgctggggacaggcatgctgccgccagtagggcggggacccggacagccaggtgactaccagtcctggggacacactcaccataaacacatccccaggcaggacagatcggggaaggggtgtgtaccaggctatgatttctcttgcattaaaatgtattattatttctttgtttcgaccctttgtttgtgaacagcttgccaggccttgagcccttgccgccttcctaacctgaaaaccatgcccagtgagcttagctggagactcaggccccatgttcctgggtagggtgaaggtggggtgaccacacaccccagggtcccaggacaggcctgatttacccctgggcttagggtaatacttgctaatcgcaccctatggactcaaatgcatcctgatttggaagatcaataaattatcttgtcaccctgagaagggcccatcctctcactgaccctggggagcccttgcagtctgtgtctggcctgccccgtaactccag

SEQ ID NO: 349577 - DNA, 433 bp, Homo sapiens
cgggctcagcacaagcctcctccagccaaggtcgccgctgatagccggctcgctgcctccatgccgcctgagtaggaggcgggcacgattttgcattgaattgagtccctgcgtgtgtaatatttatgcacccgtaacgtgtgtgtgtctgtgtctgaagcagcccccccggagccgcagcagcatcatgtcaatcaccgccgagcccccgggaaacgactccatcgtcagacgctacaaggaggacgcgccccatcgcaggtgggtggcaggtgagggaggactgggcttttgccccgtgccaccatgccaagcctccttaccccgtctctgggccagtccacgcttgctgacccagctgtcctcgaagcaaccctgaaaggcagggtactgctcattgtacagatgaggaggctgaggctcagaggaggga

SEQ ID NO: 349578 - DNA, 97 bp, Homo sapiens
gtatagaaaggtttttatatctccctctccctcatttctacaggacagctttgctaggcacagcatttttgttttcaatatggagtcttgctctgcc

SEQ ID NO: 349579 - DNA, 691 bp, Homo sapiens
tgtcctatcctatatgtgcctgaggagctcagtcattcataggattagagtcccactgctgtcctaatttcgtgaaactctggatatttgaagtgattaataatgtgacttaatccatcagttcctaagatttatatatctttctctgtccctaaggatagaaaacacaacaggctcctccctttctttattttcttactgtggatgacggtccctggaacttcagctgataaaagggctggtaggaaaacacacagggctctgcatccccaggactcagcttcatccctgtctgctgagctttgactctagaatctgactattggcctccctcttctaggattctgaacacgaccctctttgagagttgggagataatcgggccttatgcttcatggtggctcctcaatggcctgctgctgaccatgaatactggatttaaagtctgaagaacttcatttatcacccaccaactaaacttacgtaattatttttaggattaggatggacaatctgtttttttgtttttgttttgtttgagacaaacaaaacagtgtgtccactctgtcatacaggctggagtacagtggcgcaatcatggctcactgcagcctcgacctcctgggctcaagagatgctcctgcctcagcctcccaagtagctaggactacaggtgcatgtcaccatgccc

SEQ ID NO: 349580 - DNA, 660 bp, Homo sapiens
agtagctgggattacaggcgcatgccaccaggcctggctaatttttgtattcttagtagaaacggggtttcactatgttggccaggctggtctctaactcccgaccttgtgatctgcccaccttggcctcccgaagtgctgggattacaggcgtgagccaccgcacctggcctgcctgttttaccttttaagatgtgacttagacgcaagaggaaagttctaccttcttcctgtcccttaggaatggcttttgttaaaggatgatagggttaagagttttttaagagatggcctcaaccatttcctaccccttacctacctgcttcagtggatttcatatttttctttttgacatggggcccagtaaaccttttgtaaaacatagtgattagtggtgtgtagtattgaacgttggcaaacatatcaggaagaaaatgtgaagcagtggaagcaggaccactcaccaccatggcagggaggagacttaatgagtttttgcagtagtctaaactaatgtgaacctgaaggaatagtgagcaaggaaaaggattcagcctatcctaaaaatgtgaattgacagaaatttgggtaatcactataaatgtacaaggaatgggactaagagtacaggaagttactactcggggtatgtcacgagtc

SEQ ID NO: 349581 - DNA, 2044 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349582 - DNA, 2147 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtgacctgtccaggaaggattagaccctgtactttccactctttcctcacctccttccttttttctatgcctggcgggagctggacagtttcatctcttgcatgtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349583 - DNA, 2069 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggagctcaattctttcttcctttctccaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349584 - DNA, 2325 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctctactgtctcaacctcttcagtgactctatccgcagtttcctgaatccataagctaattaagagcttttccaggtctgattcagaaggccctggacaccaaatttttcctttctgtgcatggtaggaagagtcagccagggtgcttacattttagagctttatgttttttaagaaaaagaagaatcacttgaacctgggaggcagaggttgcagcgagccaagatcgtgccactgcactccagcctgggcgacagaccgagactctgtctaaaaaaaaaaaa

SEQ ID NO: 349585 - DNA, 2101 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagagatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349586 - DNA, 1449 bp, Homo sapiens
tgaggtgactctgaggatcccttcgggtttgtgcatcgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349587 - DNA, 2284 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctcaaaaaaaaaaaaaaaaaaaaaaaaaaaaaacaaaaaaaaaaaaaaaaaaaaaaaaaaaagaaacaaagagcacaacaacaacacacaaacaacccacagcgcacacgcaccaaagggccccacaagtacagaatgatcaagcgccccacccttgctccgcccctacccacacccaattacacacgaccaacaccgccacactcacccctcgggtccacgaccctacctttctggcagcgc

SEQ ID NO: 349588 - DNA, 1394 bp, Homo sapiens
tgtcctatcctatatgtgcctgaggagctcagtcattcataggattagagtcccactgctgtcctaatttcgtgaaactctggatatttgaagtgattaataatgtgacttaatccatcagttcctaagatttatatatctttctctgtccctaaggatagaaaacacaacaggctcctccctttctttattttcttactgtggatgacggtccctggaacttcagctgataaaagggctggtaggaaaacacacagggctctgcatccccaggactcagcttcatccctgtctgctgagctttgactctagaatctgactattggcctccctcttctaggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349589 - DNA, 1899 bp, Homo sapiens
agtagctgggattacaggcgcatgccaccaggcctggctaatttttgtattcttagtagaaacggggtttcactatgttggccaggctggtctctaactcccgaccttgtgatctgcccaccttggcctcccgaagtgctgggattacaggcgtgagccaccgcacctggcctgcctgttttaccttttaagatgtgacttagacgcaagaggaaagttctaccttcttcctgtcccttaggaatggcttttgttaaaggatgatagggttaagagttttttaagagatggcctcaaccatttcctaccccttacctacctgcttcagtggatttcatatttttctttttgacatggggcccttttcaaaggaaatcatatgcagaaccatataaactgtataaaagcagattgttaagttgcctagaagtggtgtgtggtagttcacaagccaccacaaggtgaccatgctgtgatattcaagatatggtttatataaggaactaaatacccacctcaccccactagtgtatgaggcaagtgtcctaagtgaatgggtatgtagtgtttcaaatacccatcttatgccaagagcgaaagaaaggtgccacttaatgataaactcataattgaactttgcaagttttgaagcagtcagactgtagtcaaagggctagggatttcagcctaaaggaatacagaatcccaagtgggaggggctctgcttgagcaggtactgatactaggaccaagtgatggaatgtggcctagatattgatgatctcctgcatcattattccttatagctgccattggctcagaacttgctcagtgtgcctgtgcatcttgctgtagctactggacatctctgttctctcctgcttttctttcctgactaggtgacctgtccaggaaggattagaccctgtactttccactctttcctcacctccttccttttttctatgcctggcgggagctggacagtttcatctcttgcatgtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349590 - DNA, 1102 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349591 - DNA, 928 bp, Homo sapiens
acttttctgtctttggtctcatcccacccaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349592 - DNA, 945 bp, Homo sapiens
tctttacacagtgaaaatattcgcttcttttatactcctcagtgccttgcagtctcccaatcacagaagagtagatatgggaagggccaagaggagtatgttgccagtggccctacaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349593 - DNA, 820 bp, Homo sapiens
taccctctgtaagcacggggttggcataattcaagatgcagtcatgtggaactaaggtgggttcagtggggaccagtgaaggcctcatggccccagtccacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349594 - DNA, 1299 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtgaggatgaaagatggcttctttcttttgggtatggaagatagggattactcaacagacgttctctctccatcaaacctggtgagccccatctactcaagcaggccaagcaaaaagcctagggctccaagcctgattagggtaccgaccta

SEQ ID NO: 349595 - DNA, 1102 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagaggtaagtgattttaccaagtttatatgccttattagtagatctgagactacgatagagtgctaataggtgatttccttctcacctttcctagcttcctgatttctttcttctcgactcctgaaagatctaagtatttccataatctcttggttaggcaggaaggtatccaagatccaggatatctatatgcaggaagagcttagtctcagttctacttttccctccaattaagatcttggtcttttgatgtaaggaaactgccatttattaatcacctcctttgtgccagggtctttcatatacattatctcactgaattacttacaagattcttatgaagtagattagtggttctcacattttaatggacatgtgaatcacctggggatcttgttaaaatgcagattctgattttgcaagtctgagatgggctcaagattatgcatctctaaaaagcttccagccagcacagtggcccacgcctgtaatcccagcattttgggagactgaggctggtgaacattgtcaccctaaagaagtgataaatgttgaaagtgattgttccccgctgggatcctctggtcta

SEQ ID NO: 349596 - DNA, 934 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagaggtaagtgattttaccaagtttatatgccttattagtagatctgagactacgatagagtgctaataggtgatttccttctcacctttcctagcttcctgatttctttcttctcgactcctgaaagatctaagtatttccataatctcttggttaggcaggaaggtatccaagatccaggatatctatatgcaggaagagcttagtctcagttctacttttccctccaattaagatcttggtcttttgatgtaaggaaactgccatttattaatcacctcctttgtgccagggtctttcatatacattatctcactgaattacttacaagattcttatgaagtagattagtggttctcacattttaatggacatgtgaatcacctggggatcttgttaaaccagtgcggggtcctctaga

SEQ ID NO: 349597 - DNA, 664 bp, Homo sapiens
catgatgaaccaagacccaagaggtaagtgatattattagtagatctgagactacgatagagtgctatatctttctctctttcttctcgactcctgaaagatctaagtatttccataatctcttggttaggcaggaaggtatccaagatccaggatatctatatgcaggaagagcttagtctcagttctacttttccctccaattaagatcttggtcttttgatgtaaggaaactgccatttattaatcacctcctttgtgccagggtctttcatatacattatctcactgaattacttacaagattcttatgaagtagattagtggttctcacattttaatggacatgtgaatcacctggggatcttgttaaaatgcagattctgattttgcaagtctgagatgggctcaagattatgcatctctaaaaagcttccagccagcacagtggcccacgcctgtaatcccagcattttgggagactgaggctggtgaacattgtcaccctaaagaagtgataaatgttgaaagtgatggatatggtaattaccccagtttcatcattatactatgtatacatgcattgaaacatcacattgtaccccataaatatgtacaattattatgtgtcaactataaataaaatttttttaaaaagaattgg

SEQ ID NO: 349598 - DNA, 973 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagaggtaagtgattttaccaagtttatatgccttattagtagatctgagactacgatagagtgctaataggtgatttccttctcacctttcctagcttcctgatttctttcttctcgactcctgaaagatctaagtatttccataatctcttggttaggcaggaaggtatccaagatccaggatatctatatgcaggaagagcttagtctcagttctacttttccctccaattaagatcttggtcttttgatgtaaggaaactgccatttattaatcacctcctttgtgccagggtctttcatatacattatctcactgaattacttacaagattcttatgaagtagattagtggttctcacattttaatggacatgtgaatcacctggggatcttgttaaagttgcgtcagatatgcatctctaataagcgtccagccagcacgtctcgcattttggggg

SEQ ID NO: 349599 - DNA, 942 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagagatttattgccaaaccctgtgcactccgtattggcatcgaggacagtggtccttatcaggcccaacccaatgccatccttgaaaaggtgttcatatctattaccaaggtaagtgggcaaagaaacagagaggaatattcacataaggcgttgctccatggggcaggggaggatagagagcacgtacctctaagggtaaggataggatgggatggtccttcatatttgagtagtccatgtagctatatggagagctttatcccctcagggaaaacctttgggccctacgtatgtcaagtttacgtacgtagtaggtttgagttttaggcccagcagccacccttacccctctttccccagacacataccatatctggtttttgtttttccttgttccagtttctgtcactgcctagttgtgtgatcga

SEQ ID NO: 349600 - DNA, 649 bp, Homo sapiens
tgtcctatcctatatgtgcctgaggagctcagtcattcataggattagagtcccactgctgtcctaatttcgtgaaactctggatatttgaagtgattaataatgtgacttaatccatcagttcctaagatttatatatctttctctgtccctaaggatagaaaacacaacaggctcctccctttctttattttcttactgtggatgacggtccctggaacttcagctgataaaagggctggtaggaaaacacacagggctctgcatccccaggactcagcttcatccctgtctgctgagctttgactctagaatctgactattggcctccctcttctaggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtgaggatgaaagatggcttctttcttttgggtatggaagatagggattactcaacagacgttctctctccatcaaacctggtgagccccatctactcaagcaggccaagcaaaaagcctagggctccaagcctgattagggtaccgaccta

SEQ ID NO: 349601 - DNA, 624 bp, Homo sapiens
caaaaggatatgtataggtgagcagtacaggtccttgatatgtaagataaaatttcttactaaaaatgactttgggataaaacttggaaagataaacatcacttgagccacttatggctatcataccttgtcgctcagctagtcaatgggattgaaggaggggtatgaggagacgggtgttctgactctggttatacattcacagtatcctgataagaaaaggctggagggcctgtcaaagcagctggattggaatgtccgaaaaatccaatgctggtttcgccatcggaggaatcaggacaagcccccaacgcttactaaattctgtgaaagcatgtaagtacgcaaggagggagggagggaataaggaagacggtgggatacaactggactgaagtttctgttttgaacatcacttctgttgttaggacaacagttaatggatatagagaactaactcagcctattataggtaggaaagaagggaactggaacactgattcccttaagtttcttgggcatgttgccactaagctaggtgtggttctattttgttcccttttcctaaatagattgggagtaaatccttataactgtacttatgtaagtagatgtactaacaca

SEQ ID NO: 349602 - DNA, 535 bp, Homo sapiens
tttgagacggaatctcagtctgtcgcccaggctggagtgcagtggcgcgatctcagctcactgcaacctctacctcccaggtttgagcaattctcctgcctcagcctcccgagtagctgggattacaggcacatgccaccaagcccggcttatttttgtatttttagtagagacggggcttccccatgttggccaggctggtctcgaactcctgacctcaggtgatccgaccaccttgccctcccaaagtgctgggattacaggcatgagccacctcgcccggccaatggaaactattctatatggggtggggtaagattcttagagaataatgcaggacgttgggttggctggtgtttctagggcccagcttttacctccctcttctatttccattccttcctaggacttcctgatcatgtttgtgcatcacttggtcaccattgggcttatctccttctcctacatcaacaatatggttcgagtgggaactctgatcatgtgtctacatgatgtctcagacttcttgctggag

SEQ ID NO: 349603 - DNA, 2029 bp, Homo sapiens
gaattccggcagcaaagtgcaaacagagccggctctgggtgaaagctttagttatgaaaaataagaaaaaaaaaatccctaagcatttcttaacactagttttaaagaaaaccccctctccaaaggtatgtttctccttcaactttcttgactttgccaggctgtcaggatgcaagctacctactcttttctggatggatcgggacaagtttttaaacaaagactgtgtcctctccacaagcccttcccaccaccaccacccagccccccgccgccataattacaggggctcttcgagcgatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349604 - DNA, 2245 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagagatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349605 - DNA, 1986 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcattcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaaggtggttgctatagggacttcagcacacatggacttgtagggccactggcaacatactcctcttggcccttcccatatctactcttctgtgattgggagactgcaaggcactgaggagtatcaaagaagcaaatattttcactttgaaagaaaactgccattttgtatttaatagcctccaggttctttcagtaatgttatttgctctgtgtgtttttgtgtgtttgttgatgtgcgtttgtgcatatgcgtgagtttcattgccggggttggggcacaattgtggactggggccatgaggccttccctggtccccactgaacccaccttagttccacatttggctgcatcttgaattatgccgactccagacttctcctccttttttgcccttggctcttgacactctaaacccctggaccatctgaatggagcagccaagttcagtcccacatttctgtactgttcctctttcacagctggaatatgtcacatgatgaagttgtatagaaacagaaccatggatggatggccaggattgccgtggtccctagctagatccccttcctatcaatcacctgatagcaacagggacagctgccaataccctgctctttactcaatggtacccagggagggagcatgggaagagggtgagctgagggctggaggagggcaacagccactgggtgagctgttcacggtcttatactattgtttgtgattaaaagtgcttcaacccacctc

SEQ ID NO: 349606 - DNA, 1204 bp, Homo sapiens
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagaggtaagtgattttaccaagtttatatgccttattagtagatctgagactacgatagagtgctaataggtgatttccttctcacctttcctagcttcctgatttctttcttctcgactcctgaaagatctaagtatttccataatctcttggttaggcaggaaggtatccaagatccaggatatctatatgcaggaagagcttagtctcagttctacttttccctccaattaagatcttggtcttttgatgtaaggaaactgccatttattaatcacctcctttgtgccagggtctttcatatacattatctcactgaattacttacaagattcttatgaagtagattagtggttctcacattttaatggacatgtgaatcacctggggatcttgttaaaatgcagattctgattttgcaagtctgagatgggctcaagattatgcatctctaaaaagcttccagccagcacagtggcccacgcctgtaatcccagcattttgggagactgaggctggtgaacattgtcaccctaaagaagtgataaatgttgaaagtgatggatatggtaattaccccagtttcatcattatactatgtatacatgcattgaaacatcacattgtaccccataaatatgtacaattattatgtgtcaactataaataaaatttttttaaaaagaattgg

SEQ ID NO: 349607 - DNA, 955 bp, Homo sapiens
  misc_feature (813)..(813): n is a, c, g, or t
  misc_feature (816)..(816): n is a, c, g, or t
  misc_feature (818)..(818): n is a, c, g, or t
  misc_feature (821)..(821): n is a, c, g, or t
  misc_feature (823)..(823): n is a, c, g, or t
  misc_feature (826)..(826): n is a, c, g, or t
  misc_feature (831)..(831): n is a, c, g, or t
  misc_feature (835)..(835): n is a, c, g, or t
  misc_feature (838)..(838): n is a, c, g, or t
agcggggcaggtggtggccgccggccgggccccgccctggggccgcctccccgcgggttccgttggctgtggcggcagctgacgcttgtggcggcggtggcttcggggtgggcgtaagatggcgacagcagcgcagggacccctaagcttgctgtggggctggctgtggagcgagcgcttctggctacccgagaacgtgagctgggctgatctggaggggccggccgacggctacggttacccccgcggccggcacatcctctcggtgttcccgctggcggcgggcatcttcttcgtgaggctgctcttcgagcgtagagacggggtttcactatgttgaccaggctggtctccaactcctgaccttgtgatcctcctgcctcagcctcccaaagtgctgggattacaggcgtgagccaccacgcccggcttttttattctttttaaaaatttaaatccttgggactctgcttgatataacctcttcttttagatgatgaaaccaagacccaagagatttattgccaaaccctgtgcactccgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgcnacntnggntntgngactncganagnggtgggaataaactatccattgcaggcctctttcaggtggggctatatcagctattatctcatggactggccctctatgggcccctatgttcctacagtaccgccttacacccacag

SEQ ID NO: 349608 - DNA, 203 bp, Homo sapiens
gcccctcagtaccagaaatattaacaggtaacaggtaaagtgcacgtcatgaggaattccgaaattccgaaattacatgaagttttgcatcctgaatttatttttgagggtgcacgaggcagttaccccgtctctgtttgcagtagcctgagttccgatgaactcactgatggcctccatctcttctgactttgcaaacgttg

SEQ ID NO: 349609 - DNA, 455 bp, Homo sapiens
actgttatgaggaattaacctgagttaagtacataggctttacctccagccttagcttaattcgtttacttctttgcaaaattgtagattaatttatttgagtcttttaaatattttctttttgtggccagagggtttaaggatcccttaagcccaccgcattagcataagtcaaaagtctgaacaacatcattctcaagaagaaaattaagccacatgtcctccttctacattatgtttgtgaaagtgtagttttattatgaggaaaacagcctttagcttttgttgaatggttcaagaaaaaacataacatagataaatttaggtaacattaatagaaacatttttcattaataattggttttgataaatctatgcggtttatcaatgggactcatgtacaggttgccaaaaactaattattctccctgagaaataatacttaaagcacttag

SEQ ID NO: 349610 - DNA, 2232 bp, Homo sapiens
cgcgcccgcggccctccgtcccgccccggccggctggcggtcacctggcacaccagcgcccgcaggatgcccaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcgcttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgctccaaactgggtgacatggtgagaccttgtctcca

SEQ ID NO: 349611 - DNA, 2107 bp, Homo sapiens
tgtcgtcgtgtccaagggttggttcccaccttgcaccctgagctgaggggataggcttcagccaccctcgaccctgaactggaataattaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcgcttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgctccaaactgggtgacatggtgagaccttgtctcca

SEQ ID NO: 349612 - DNA, 1978 bp, Homo sapiens
tcttctctgtgctgcgagtggctagctgggcagagccctgggggcgcggtgctgccgcctccaggtctccgccccgtgtgtgcgccctgcacttagggatccctccctcactgccccggtactcacaagcttctcggccccgaccttcgccctgggaggttctggccaggtgccgggaggggcgctgtgtcgagggcgatccccccaaagcagcgtcccgtgctaaagaaacagagcctcactctgtcacctaggctggagtgcagtggtgcaattatggctcactgcagtttcaacctcccagattccagtcatcctcctgcctcagccacccaagaagctgggaccacagggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcgcttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgctccaaactgggtgacatggtgagaccttgtctcca

SEQ ID NO: 349613 - DNA, 2248 bp, Homo sapiens
tcttctctgtgctgcgagtggctagctgggcagagccctgggggcgcggtgctgccgcctccaggtctccgccccgtgtgtgcgccctgcacttagggatccctccctcactgccccggtactcacaagcttctcggccccgaccttcgccctgggaggttctggccaggtgccgggaggggcgctgtgtcgagggcgatccccccaaagcagcgtcccgtgctaaagaaacagagcctcactctgtcacctaggctggagtgcagtggtgcaattatggctcactgcagtttcaacctcccagattccagtcatcctcctgcctcagccacccaagaagctgggaccacagggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcgcttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgctccaaactgggtgacatggtgagaccttgtctcca

SEQ ID NO: 349614 - DNA, 2386 bp, Homo sapiens
tcttctctgtgctgcgagtggctagctgggcagagccctgggggcgcggtgctgccgcctccaggtctccgccccgtgtgtgcgccctgcacttagggatccctccctcactgccccggtactcacaagcttctcggccccgaccttcgccctgggaggttctggccaggtgccgggaggggcgctgtgtcgagggcgatccccccaaagcagcgtcccgtgctaaaggtactgcttaggatgaatatgatttggagaaattccatttcttgtctaaggctaggaaaggtgccacacagataccaaagtggttaccacccagtggcccctctgggatcaaggattttaactgacccagccaaagtttttgaacacaacatgtgggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcgcttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgctccaaactgggtgacatggtgagaccttgtctcca

SEQ ID NO: 349615 - DNA, 2231 bp, Homo sapiens
tcttctctgtgctgcgagtggctagctgggcagagccctgggggcgcggtgctgccgcctccaggtctccgccccgtgtgtgcgccctgcacttagggatccctccctcactgccccggtactcacaagcttctcggccccgaccttcgccctgggaggttctggccaggtgccgggaggggcgctgtgtcgagggcgatccccccaaagcagcgtcccgtgctaaagggatcacatgcagtggtctaaggaagaagaagcagcagccagaaaaaaagtaaaagaaaactcagctgtgcgagtccttctggaagagcaagttaagtatgagagagaagctagtaaatactgggacacattttacaagattcataagaataagtttttcaaggatcgtaattggctgttgagggaatttcctgaaattcttccagttgatcaaaaacctgaagagaaggcgagagaatcatcatgggatcatgtaaaaactagtgctacaaatcgtttctcaagaatgcactgtcctactgtgcctgatgaaaaaaatcattatgagaaaagttctggttcttcagaaggtcaaagcaaaacagaatctgatttttccaacctagactctgaaaaacacaaaaaaggacctatggagactggattgtttcctggtagcaatgccactttcaggatactagaggttggttgtggagctggaaatagtgtgtttccaattttgaacactttggagaactctccggagtcctttctgtattgttgtgattttgcttctggagctgtggagctcgtaaagtcacactcgtcctacagagcaacccagtgttttgcctttgttcatgatgtatgtgatgatggcttaccttacccttttccagatgggatcctggatgtcattctccttgtctttgtgctctcttctattcatcctgacaggatgcaaggtgttgtaaaccgactgtccaagttactgaaacctgggggaatgctgttatttcgagactatggaagatatgataagactcagcttcgttttaaaaagggacattgtttatctgaaaatttttatgttcgaggagatggtaccagagcatatttctttacaaaaggggaagtccacagtatgttctgcaaagccagtttagatgaaaagcaaaatctggttgatcgccgcttacaagttaataggaaaaaacaagtgaaaatgcaccgagtgtggattcaaggcaaattccagaaaccattgcaccagactcagaatagctccaatatggtatctacactcctttcacaagactgaactttgtaacatgttaaggtacaaagccagaggactgtgctattcaaggactactgtaagtctattgtttctcaaaagacaatgagaaaaaaagaagagaatttgtatttcctgccgttttgtcataggtgagctcctttgtgcattttaagcacatgtaagtggttcagcacagtatgcctttttctgtgctttgaaaacttgatatgctcaagcttgtttgaatttattacatctaaccattttgcttgttccttgatttttataagcattcaattaagttagtattatgtcaagtaattttgagaaaatgtaacttgacattttttgcaagtaaaaaaaattgtttatttgtttaggcttagtaaaccagttcccaaacacagtcagactcttcccattgtcatctgattgcagagagaaagcacaccttatttccagggaaagctacaacaagcccaaggtcaaagtgtattattttttgtcttgttgttgtctattttctcccaatttttttttgaaattcagaggctcatatctgaaatagaattttagttcctctttcctttcctaaaattggggaagtacagcccatgctgacattattttcaggctattcttagatatacaagttgttaggccaggtgcaatggctcgcacctgtaatcccagcactttggggggctgaggcaggcagatcgcttgagctcaggagttcaagaccagcctggacaacatggcaaaaccctgtctctcccaagaatacaaaaattagccaggcatggtggcacacacctgtggtcccagctactcaggagactgaggtgggaggatcgcttgagcctcggaggcggaggttgcagtgagctgagattgtaccactgcgctccaaactgggtgacatggtgagaccttgtctcca

SEQ ID NO: 349616 - DNA, 372 bp, Homo sapiens
aaagatggtcatccatggaaatggccaaggctgaaaggatctggcattccgtcccgtttattgaatccctccagaaccaatctgatatcgtataaagctcacgaagaaataaaaatagtcaccttaatcatcaaaaaggtaattgcaaagggcactgttgcctgaaattctctagtcacctgaaaactgaaataactgaggcaagacttcttaaaatgcttagtttcaaacttaaacagaatggcctgataatgatcaaacatgtacagagaaatacatgaaatcagaattgtgaatgcagagaaataactgttttgctagtttaaaagtctgaagcttttccctcctccccagctgttaatgtaggagaca

SEQ ID NO: 349617 - DNA, 358 bp, Homo sapiens
cgtcgacgtttctttaaaaaaaaaaaaagaaaaagaaaaagaaaaagaaaaatattttaggcttagaattatctaatggaaaaaatgtaaaaaagtacaaaaatgaactaaaagtatatcagtatttgcattgtttacatataccctgcatttaaaccaattaaaacaatccaagtttctttaaaaaaaaaaagaaaaagaaaaagaaaaagaaaaatattttaggcttagaattatctaatggaaaaaatgtaaaaaagtacaaaaatgaactaaaagtatatcagtatttgcagtatttacatataccctgcatttaaaccaattaaaacaatccaagtttctttaaaaaaaaaaa

SEQ ID NO: 349618 - DNA, 4441 bp, Homo sapiens
agggagctcagcggagctgcgcgcctccgcctccagctcccctgccgcagcgcgccgcagccgggcgtccccgcgcgggcgccggagaggaaggaaggctggcagcctcgtcacgtgtccgctgcagtcgcgaaacagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttggtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttggttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaa

SEQ ID NO: 349619 - DNA, 4499 bp, Homo sapiens
  misc_feature (71)..(71): n is a, c, g, or t
cactgtcgcgatcgatcgaggctgagcaggggacgctgtgggcgcggctcaggccatggccctttcccagntgctctggctaattgcttgaaaacaccttctagttccaccttgtaactggactcccaaaagatgaatgctgacatcttctgatgcttaacaagaaataaaaatagtcaccttaatcatcaaaaagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttggtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttggttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaa

SEQ ID NO: 349620 - DNA, 5121 bp, Homo sapiens
agggagctcagcggagctgcgcgcctccgcctccagctcccctgccgcagcgcgccgcagccgggcgtccccgcgcgggcgccggagaggaaggaaggctggcagcctcgtcacgtgtccgctgcagtcgcgaaacagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttggtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttggttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaagaaaaagaaaaagaaaaagaaaaatattttaggcttagaattatctaatggaaaaaatgtaaaaaagtacaaaaatgaactaaaagtatatcagtatttgcagtatttgctgtgattacttaggtttagactttctcaacttcttagatgactaaatgggctgaagacttgtaactaacttgaataggatagacttcataccctgtgacaaaaaggatggggaagagaatatcattggtcttgccatatacctcctagctaaaaggaaaatggtttgtagttgttcttgggcctactgtgttgcttttcagaaggacataagactttctactttatctgatatggatatcgtctacttcctcattcctttatgctcacttatggagtagttacatagaaatataactcttggtggtactgtattttaaggtaattcagaagcagtatgtattatttatgtacatgtacaggacaccattcaaaatggcttgaaaatattcagcatgtttgttatttgctgttatattgtatgtttagttttgtatgtgataaacagaattgatgtaagtttttgtggacttgaatttctccttccttgagatcaattaaacagcagaaaaatcttcttggttataatgtcgacgcgggccgccattttggtattattcgtcgac

SEQ ID NO: 349621 - DNA, 5055 bp, Homo sapiens
agggagctcagcggagctgcgcgcctccgcctccagctcccctgccgcagcgcgccgcagccgggcgtccccgcgcgggcgccggagaggaaggaaggctggcagcctcgtcacgtgtccgctgcagtcgcgaaacagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttggtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttggttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaagtacaaaaatgaactaaaagtatatcagtatttgcagtatttgctgtgattacttaggtttagactttctcaacttcttagatgactaaatgggctgaagacttgtaactaacttgaataggatagacttcataccctgtgacaaaaaggatggggaagagaatatcattggtcttgccatatacctcctagctaaaaggaaaatggtttgtagttgttcttgggcctactgtgttgcttttcagaaggacataagactttctactttatctgatatggatatcgtctacttcctcattcctttatgctcacttatggagtagttacatagaaatataactcttggtggtactgtattttaaggtaattcagaagcagtatgtattatttatgtacatgtacaggacaccattcaaaatggcttgaaaatattcagcatgtttgttatttgctgttatattgtatgtttagttttgtatgtgataaacagaattgatgtaagtttttgtggacttgaatttctccttccttgagatcaattaaacagcagaaaaatcttcttggttataatgtcgacgcgggccgccattttggtattattcgtcgac

SEQ ID NO: 349622 - DNA, 430 bp, Homo sapiens
  misc_feature (71)..(71): n is a, c, g, or t
cactgtcgcgatcgatcgaggctgagcaggggacgctgtgggcgcggctcaggccatggccctttcccagntgctctggctaattgcttgaaaacaccttctagttccaccttgtaactggactcccaaaagatgaatgctgacatcttctgatgcttaacaagaaataaaaatagtcaccttaatcatcaaaaaggtaattgcaaagggcactgttgcctgaaattctctagtcacctgaaaactgaaataactgaggcaagacttcttaaaatgcttagtttcaaacttaaacagaatggcctgataatgatcaaacatgtacagagaaatacatgaaatcagaattgtgaatgcagagaaataactgttttgctagtttaaaagtctgaagcttttccctcctccccagctgttaatgtaggagaca

SEQ ID NO: 349623 - DNA, 4383 bp, Homo sapiens
aacaagtgaaaaaccaacccgatactggtggtaggaccatttgcaatcaatagttactgacagtattctgttgcttctagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttggtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttggttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaa

SEQ ID NO: 349624 - DNA, 4665 bp, Homo sapiens
agggagctcagcggagctgcgcgcctccgcctccagctcccctgccgcagcgcgccgcagccgggcgtccccgcgcgggcgccggagaggaaggaaggctggcagcctcgtcacgtgtccgctgcagtcgcgaaacagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagctcctgggacctacgagatatggccctgcttctgaacgcagagaacaaaacggaagccgtgccccgagtgggaggacttcttgggaagtatatcgatagacttattcagcttgagtggctgcaagtccagactgtacagtgtgaaaaagcaaaggggggcaaagcaaggccccccactgcccctgggacctcaggggcactgaaaagccctgggagaagtaagctaattgctagtgctctgtccaagccactacctcaccaggaaggggcttcaaagtcaggcccttcccgaaagaaagcttttcaccatgaagaaatccacccatcacattatgcatttgagacttcccctagacccattgatgtgcttggtggtaccaggttttgttctcagaggcaaacccttgaaatgaggacagaagaaaagaaaaagaaatcaagtaagagtacgaagctgcagcgctgggatctgtccggcagtggaagcagctctaaggtggaaaccagcggtcacattcgagttcccaaacaggcagctgtgattctggactcagcagattcctgtaaggcctccaaaacacaagcacatgcacatcctaggaaaaagggaaaggcagagagctgtggtcatgccactgtatcgagtgagaaaaaactgaaaacaaacggagtaaagcaaaacacatataaactaaaataaatatctaaaatgctgaattgccaagacctgcaggtacctcaatgttagagcgcttccaaaagtcaaaatactgtgaattttaaggaattttacaaatactgacatttaagtagttgactggcatttttgtccacctttatttctaccctgagtggggttattttcaaagggaagtgtctttcaataagcctttctttgtattgtcagtcttaggcaaatgagagccctttagataaaaattatgtaaaatatgtgccatataaaggaataaaatggcacctctccagggaaagtgtcagtgaaacctcagctacagtagccggtctgtgtagagcagctagtggtgttacctccccattttcacatgcacgtaagtatatgaaatagtgcagactgtttcaaatggtgtggaatcctaaatgtttaaaataaggtccttcttgcccactccctcgcttacttttttataaactcctcaagcaaaatttctgttcattttacccttaggagaagctttagttcttcctcaagtcagggagtagtgagtttgtattttgagtagtcatttctcactaagctggttgctttctagagagacagtggaatctagtactttaatacattttctctgacatggttttttttttcttttttgaggggcattttaaacttagaggtggtggtaaaacctacttttgagttctccgaactgaggttaaaataacttgcagaattttccaaagtcaatgggcttagcatgattactgctgtttggtggggctgagaatgaaatatttgacattctggaattgctggcatgtaaagcttctccagagaggcaccccagggaaatcactctttacaatttggtaaaggaagggcctgtaaaaggatcaaaacacatggacctacattcagtgtaatagttacaaagttactgatttgggttccacaccctgtggtccttagtcaaaaataatgatctgtttcagtttgcaagagcaggattttattattttgcttggggtgaggggcgggagagtggaatatgagtaaggttgctgaatgaattctaaactcgcttatctggtcttcaggcttcccaactctctccaagccttcttatttcactgcagttaaataacatcttcttggttcctatagttgtgctgtgagttttctgttcatatttgcgcagtgtattttaatacggcccatgtcattatagttgattttatccctttaaacaattactgtatttgtttttgacgtagaggtttcaattttttcaccttgggggcaaatgaaaaacttggcatttttcatttgggaacatataatagcttgtaaacttttcagacagcagtaaatgtctgaaaaaatatcaaaaacagcataaagacaagattatgtagctctaattatacgtatataattataaaaaacaatgtgcaagggttatattttaaggtcttttaaaatctgattttgatcataccaaatgacataatattttttatggtagccttttactttcaagacttaattttcagacttgtacaagttccttcttacattctttccctctcacaccatcctactggagaaagcatacttttatgctaagatcttactttaagctttttatgtgaacaaaagatgtacatatagtaagtattacttccgtagtcctcaaatttactataacttttgtacttagtatatgttttatatttggaaaacagcactacgcttagttttcctgtagttcctgagtgatgtctgtgtgttccttgcctgcccttttttgtgagcacagattagtctgttatccatggctggcacttcacttatgatcctttctctgctagatttttatgcagctctctatgaagtttcatggcccatagatattcaaaagcaagatattctatacatatgtgtatatgtatatatactccttatgttaatactaaagtgtttatgctgagttgctgcctttccccgtcatgtatccatgtgcatgctcttagagaccttgaatggttgagggtaaagtgatttattagtaattctacttgccttgtgtatgtctgagctgaaaacaatcgtgattaagaaatttagaggtggctgggcgtggtggctcacgcctgtaatcccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaagatcgtgccattgcactccagcctgggcaacaagagggaaactccgtttcaaaaaaaaaagaaaaagaaagaaattgagaagtaacgcctcataatatttgttcccagctttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaagaaaaagaaaaagaaaaagaaaaatattttaggcttagaattatctaatggaaaaaatgtaaaaaagtacaaaaatgaactaaaagtatatcagtatttgcagtatttgctgtgattacttaggtttagactttctcaacttcttagatgactaaatgggctgaagacttgtaactaacttgaataggatagacttcataccctgtgacaaaaaggatggggaagagaatatcattggtcttgccatatacctcctagctaaaaggaaaatggtttgtagttgttcttgggcctactgtgttgcttttcagaaggacataagactttctactttatctgatatggatatcgtctacttcctcattcctttatgctcacttatggagtagttacatagaaatataactcttggtggtactgtattttaaggtaattcagaagcagtatgtattatttatgtacatgtacaggacaccattcaaaatggcttgaaaatattcagcatgtttgttatttgctgttatattgtatgtttagttttgtatgtgataaacagaattgatgtaagtttttgtggacttgaatttctccttccttgagatcaattaaacagcagaaaaatcttcttggttataatgtcgacgcgggccgccattttggtattattcgtcgac

SEQ ID NO: 349625 - DNA, 2051 bp, Homo sapiens
agggagctcagcggagctgcgcgcctccgcctccagctcccctgccgcagcgcgccgcagccgggcgtccccgcgcgggcgccggagaggaaggaaggctggcagcctcgtcacgtgtccgctgcagtcgcgaaacagttccggtggtgaggagacctttccaaatataagaggaataaagaagtcacctccccagctgtcatcatcttccagcagattgagcaagaatattttgagcactacaggaaagacagtccatcaaacccgagatgatgatcagccacgtgattttttcaagaagaggaatagggtgaatgaatctcatcagaaaagcagcaatatgaatgctggcccatcttggaataaagtgcaacattcaaagaattcttcaggaaaaaggcagagtaaatcccaagtaccccacgcttcttcccagccgagaagcagcctcacagctgtcacccagcctactgaagaaaaacttaaagaaagcatttccccggaagcaagacgcaaaaggaatccactcggttccaggtgtcagggggcctcagggaataaactgtttcttgattttcagtcaatgaaaattattaaagagaatgctgatgaggacagtgcaagtgatctctctgattcggaaagaattcccattcctccttctcccctcacacctccagatctcaatcttcgagctgaagaaattgatccagtttactttgatcttcaccctggtcagggccatacaaaacctgaatactattatcctaatttccttccatcccctttcagctcctgggacctacgagatatggccctgcttctgaacgcagagaacaaaacggaagccgtgccccgagtgggaggacttcttgggaagtatatcgatagatttttaaattgaagctggttgcataatctggggaatagtcataatttcatgtgttatacagtttaaaaagcctgcaaaagtgactttgcttgtttactttctgcctcagattgactattttaaccaatattgtcacgactagatcatagctcctagtgaataacatgaggtgttttaaagttaggtctattacagaattaacataagcacaattttaattttatgatatctgatatgcctatctaatacatcttaatgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaagaaaaagaaaaagaaaaagaaaaatattttaggcttagaattatctaatggaaaaaatgtaaaaaagtacaaaaatgaactaaaagtatatcagtatttgcagtatttgctgtgattacttaggtttagactttctcaacttcttagatgactaaatgggctgaagacttgtaactaacttgaataggatagacttcataccctgtgacaaaaaggatggggaagagaatatcattggtcttgccatatacctcctagctaaaaggaaaatggtttgtagttgttcttgggcctactgtgttgcttttcagaaggacataagactttctactttatctgatatggatatcgtctacttcctcattcctttatgctcacttatggagtagttacatagaaatataactcttggtggtactgtattttaaggtaattcagaagcagtatgtattatttatgtacatgtacaggacaccattcaaaatggcttgaaaatattcagcatgtttgttatttgctgttatattgtatgtttagttttgtatgtgataaacagaattgatgtaagtttttgtggacttgaatttctccttccttgagatcaattaaacagcagaaaaatcttcttggttataatgtcgacgcgggccgccattttggtattattcgtcgac

SEQ ID NO: 349626 - DNA, 434 bp, Homo sapiens
ctctctgagctctgaaagttctttaatctgtaaaaatgagattattatccttgttttgtaggcttgatacaaggaacagcagtaataatgtatataaagggtttagcacagtgcctacatttggtaaatttttaaataaataaaggcagctcatatggtagtatttcaccagtctcctctcctcccatctttgagctttcatacatggtattttcattctctagaattctcttcctcttactttactgcctcttcctctccctactccactttttaaaaacatattcatgttttaggttaagcaccacctcctctaagaagccttcctttgaccccctccctggaccagactaggtttcccctagcactgtgaatttatctttaatatggagtggtaatcatactatgttgtatttgccaactgactgaactcc

SEQ ID NO: 349627 - DNA, 732 bp, Homo sapiens
ctgtctcccgttctacctctgccacccctggaactgcaagaccaactctcctcttccttctcagtctactcagtgtgaagataaggatggagacatttatgatgatccacttccacttaatgaatagcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349628 - DNA, 659 bp, Homo sapiens
  misc_feature (42)..(43): n is a, c, g, or t
  misc_feature (45)..(46): n is a, c, g, or t
cgggagggcccgccttggccaagcagggcttcgtcttttttnngnngtttccgtcttgtgacccactttagaccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349629 - DNA, 1969 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgatcctcacggtgacgcttttccccagcttttccgagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349630 - DNA, 1998 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgatcctcacggtgacgcttttccccagcttttccgagtaggatcgtgcccaggggaggaggcagagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349631 - DNA, 1419 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349632 - DNA, 2723 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacattttactctgtcttctacttgcttttgatttagaaggcagacccctagtggatgagaaatgagcccatacggtagtttttatagtagagaatgtttcaactgagcctaaactggatttctaagtctgggtcgttatgatgaagggggaaacagtctgaaggtatctgtttgcaggaaatagtttgcattggggtgggattatgtggaaaagggggcctcaggatagagaatttccttgtcttcacctgtggatgactggagaaaatgctactggcagaagccattttcatagggaggcaaaagaagtacagtttgtggttcagatgacaaagcaagaaacagaattgggggagagggcatttccacagagatacagcgtgttcctggtgcactgaaatcttaacagaagtttatgtcatttggttgctccatgagattaccatttgggaatctcgggttcccagagaagaaaaagaggcaaaggcaaggcactgtccctcaaaagaggctgaggcaaggcactgtccccaagttgaccttcctgagcagcagatatcaacaagacgactggaggaaaacgacaagagaagcagcacaagacatacccccagtggtgcccagaaattgctgcattatataaatgtggaaatacgagttatttaatatttgtattcccaaactagtgaagtctagtgatgcttaggttatatttctaagaagggcatttttcttgaaatacattatattaaataaatattttcttagagaattaaagaggaaagggactactttg

SEQ ID NO: 349633 - DNA, 2091 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacattttaaaaaaaaaaagcggactcgttggccttcacggcggagctttggcgggcgttttcgtttattgaggggtgtatcttaggcctcgcccactgactcgccaggattaggcctttggctgtcagaagccgtttcactcctctcacggggtaattggttat

SEQ ID NO: 349634 - DNA, 1581 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggatatgcatgtatccccaagggcagccagggactttgaaagagcccagtggaacctacacctaagtggaaatggaattctttccttttattaaaaccttcag

SEQ ID NO: 349635 - DNA, 1140 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgcttatatgtttaatagaccatacagcagaaaattggaggccgaagctgacaaaattggactactgcttgctgcaaaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349636 - DNA, 485 bp, Homo sapiens
catgaaaacaactgttcactgtagatttttcagtggttctcttttatgtgttataatcaagataccttttattaaaaaaataacaatacattctttgttttacatggagcatattagggattactgaaacaatctgaatacattgatgtatatatatagtatttttttattttattatttctttataggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtg

SEQ ID NO: 349637 - DNA, 1935 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349638 - DNA, 2008 bp, Homo sapiens
gccttcctgaactcttcagctactcatggatgtctttttaagaatgcatacagttctcattctgttgcccacgccggagtgtagtggcacaattttggctcactgcagtctcttgcctcccaggttcaagtgattctcctgcctcagcctcccaagtagctgggtttacaggtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349639 - DNA, 1806 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgcttatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349640 - DNA, 2086 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacattttaaactataaggccgctcttaccagcctcagctccgcctctttctattctgcttaccaaatgatttatttggcccttttggcctttgggggggagttctggccccctctcctttttgggggggaaaattagagcccccgtcccataactcgct

SEQ ID NO: 349641 - DNA, 1785 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacatttta

SEQ ID NO: 349642 - DNA, 1722 bp, Homo sapiens
  misc_feature (69)..(69): n is a, c, g, or t
agcgaagggcgccccggccggtatggcgggcaggaagtgcgagtgcgcgcctgcgcataggtcgggtcngcggtgtcaccgctttcgcttctgcttgagtaatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagtttgttgatagcctgcatggccaacccaagatgccagaatggttatctacacacccttctcatggcaatcgagttgagtacttggatagacttatacctcagaggaggaaactgaagcacataaggtcaaatgaacagcctgaggttacctgcttaataagaagtctggctaagttgtatgctattgaagttaaagggatttaatgcgggatatttgtcttctgggtgaaaatctaaagcaatggctccccatattctgaccaccgatgaccacatatctgattttcttacatcattaactccacccttgaaagatttcatccaataaaaacactgtactcatta

SEQ ID NO: 349643 - DNA, 433 bp, Homo sapiens
tttttagagacagggtcttgctgtcacccaggctggagtgcagtggtgcaatcacggttccctgcagcctcaacctcctggcctcaagtgatcctcccatctcagcctcctgagtagttgggattacaggtgtgtgccaccacccttgactaatttttgttatttttttgagagacagggcatggtagtgtgtgcctgtaatcccagctactcgggaggctgaggctagacaatcgcttgaacctgggaggtagaggttgcagtgagccgaaatcgcgccactgcactccagcctgggtgacagagcaagacactgtctttaaaaataaataaataaaggtcttggtggaaccagatcagctctgccacagctcattattctgtcatttgttggcacctactgtgtacccagacctgctccaagaccctgaag

SEQ ID NO: 349644 - DNA, 1163 bp, Homo sapiens
gcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtaacagagaatatggccagtgcttgagttctttctccttctctctctctcttttttttttaaataactcttctgggaagttggtttataagcctttgccaggtgtaactgttgtgaaatacccaccactaaagtttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgttgtta

SEQ ID NO: 349645 - DNA, 1895 bp, Homo sapiens
gcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtaacagagaatatggccagtgcttgagttctttctccttctctctctctcttttttttttaaataactcttctgggaagttggtttataagcctttgccaggtgtaactgttgtgaaatacccaccactaaagtttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgttgttaaaaaaaaaaaaaaaaaaaaaaaaaaaaaaaaaaaaaaaaaaaaaaaaaaaaaaaaaaaaaggggggggcggccaaaaaaacccccacggaggggcaccaaagaaagagagacacagatttaagtacacaaagagggcccacataagagaacaatataaaaacacacaaccacatcgggcacggctaatacaacagcagctcacaaggggaaaaaatggacacagtggagaccactgctggaagaaaacccacaaacagcggggcgcgcacaaaacatgtgaggacacaaaacccacaaaaggagactatacgacggcacaacagagagacaaatataaaaacatcagaagaagggacacaccgaggggcaacaaacaaacggagacaacagagaggcggcgcagagaacacctacgagcacacggggacatcaaaagtcagccgcaaccacaatatcttaaccaaggagcggggagcgacacataaaacatagcacgacagcgaaagaacaaacaaaacgaaaagccacaaccagaagaccagcacaagcagacaacagcgagtcaagcagagcagagacgaacgacgaagatagcacaggcagcgaagacgccgaaaaacgacagaagtagaacaacacagtcagaacaaaagagacaacaagacagacagaacaac

SEQ ID NO: 349646 - DNA, 2328 bp, Homo sapiens
gcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtaacagagaatatggccagtgcttgagttctttctccttctctctctctcttttttttttaaataactcttctgggaagttggtttataagcctttgccaggtgtaactgttgtgaaatacccaccactaaagtttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgttgttaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaacgaaaaaaaaaaaaaaagacaaaaaagagaaaacaaaaaaaagaaaagaagaggcagtaaggaaggagacagacaaacacacaaacagagagcgaacggaacacaaccaaaggccacgacgacacgacgacaccagacggcgcaggagctgagagcaggcgcgaagaggcagagaacgtagagagggagaagagggaggggctgacgaaggcatagacacagagctagatagtacagtggcgaggcggcgagagccacgaagagcggtcggacagtcaaccaacagtaagcagggagaagcaataacgactacggagcgagatagagagaagataaagatgagagaagagagtgtcacacgaagtagcgaatggaatgaaacgcagctggcgtggataacgacaagaagagaagtgggagatgaagaggtgagtggagcaaaaaaaagaacaataaaggaaggagagcggagacagaacgaggggagaggaggagagaggagagagaagaaagaaacaaagacgcagacggagcgagcggaggcgagagggcgaaggaaggagcaggaaagagaagaagagacagagaggacaagaagaagagagtgagaggagaggaggaagcgaaaagagaagcgagagagaggagggggaagagagcagcagagacagggggaggagagacagggagagaagggaggaagggaggagaagagaagggcacagaggggaaaagcaagaaggaagagagagcgagggggacggagacgggcaaggaagagacgaggaggagacgagagaaagaagagcaaggcaagagagagcaagaacacgaaagagcggagaggcaggagcagagacagagcgacagcagaaagaagagagagaaggagcgagcagctacgcacgaagcataaacaggatgaggagaacaacagagagagaagaagagacaaaaacataggagaaagaagaacgacagcacagaagaagaagaaggaaagaaaggaacgaacaaa

SEQ ID NO: 349647 - DNA, 1214 bp, Homo sapiens
gcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtaacagagaatatggccagtgcttgagttctttctccttctctctctctcttttttttttaaataactcttctgggaagttggtttataagcctttgccaggtgtaactgttgtgaaatacccaccactaaagtttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggttcgcggtcaccgtgaagggggccagccacccgggggccgcagcggcgcgtctctgaacgcgagccgggcccttcccg

SEQ ID NO: 349648 - DNA, 960 bp, Homo sapiens
gcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtaacagagaatatggccagtgcttgagttctttctccttctctctctctcttttttttttaaataactcttctgggaagttggtttataagcctttgccaggtgtaactgttgtgaaatacccaccactaaagtttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgttgtta

SEQ ID NO: 349649 - DNA, 1217 bp, Homo sapiens
gcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtaacagagaatatggccagtgcttgagttctttctccttctctctctctcttttttttttaaataactcttctgggaagttggtttataagcctttgccaggtgtaactgttgtgaaatacccaccactaaagtttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgctgattgtatggttttcacctggacaccgtgtagaatgcttgattacttgtactcttcttatgctaatatgctctgggctggagaaatgaaatcctcaagccatcaggatttgctatttaagtggcttgacaactgggccaccaaagaacttgaacttcaccttttaggatttgagctgttctggaacacattgctgcactttggaaagtcaaaatcaagtgccagtggcgccctttccatagagaatttgcccagctttgctttaaaagatgtcttgttttttatatacacataatcaataggtccaatctgctctcaaggccttggtcctggtgggattccttcaccaattactttaattaaaaatggctgcaactgtaagaacccttgtctgatatatttgcaactatgctcccatttacaaatgtaccttctaatgctcagttgccaggttccaatgcaaaggtggcgtggactccctttgtgtgggtggggtttgtgggtagtggtgaaggaccgatatcagaaaaatgccttcaagtgtactaatttattaataaacattaggtgttgtta

SEQ ID NO: 349650 - DNA, 607 bp, Homo sapiens
cagaccctccctcacaggcctcaggaggaaccaaccctgccgacaccctgacctgaacttcagccttcagaaccaagagacaatgaatgcctgccattgaagctaccgtcttcagcactttgttatcacagccctagcaaactcacagaggggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccaggtacagcatggaccccagatcacccccaccccactccctttcagtgattattgtcttatgaactaggagggggagtggggcagagatgcctctttcatggctccctgcacacacagaacccctttgtactgggcacttctactcccaaggaccctgacttgcacccagcagctaaggtcatctcacccccacctcccacctgcccctgggccagcaggaggggcttggccatatgtaggcgagacaggacttcttgaagctgaaagatttcccaccccataaaagagccagaatgtgacaaaaaaa

SEQ ID NO: 349651 - DNA, 488 bp, Homo sapiens
gcccaggggtcccccccctgccctgtagaaggggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccaggtacagcatggaccccagatcacccccaccccactccctttcagtgattattgtcttatgaactaggagggggagtggggcagagatgcctctttcatggctccctgcacacacagaacccctttgtactgggcacttctactcccaaggaccctgacttgcacccagcagctaaggtcatctcacccccacctcccacctgcccctgggccagcaggaggggcttggccatatgtaggcgagacaggacttcttgaagctgaaagatttcccaccccataaaagagccagaatgtgacaaaaaaa

SEQ ID NO: 349652 - DNA, 2931 bp, Homo sapiens
gcggccgccggggcggtgctggggaaacccttggcgcccccgcggagcggtcccaaggagggggcggtgcctggagggatggtccgccccgactgcgggtttctagccctcgcgtggcgtggggacaattaggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349653 - DNA, 1988 bp, Homo sapiens
cagaccctccctcacaggcctcaggaggaaccaaccctgccgacaccctgacctgaacttcagccttcagaaccaagagacaatgaatgcctgccattgaagctaccgtcttcagcactttgttatcacagccctagcaaactcacagaggggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349654 - DNA, 1913 bp, Homo sapiens
ttcagttgtatttactgtgtccctgtggctgtcaatatcacataggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaagaaacaagaagcataaaaggactgcaggaggtgctgtgggttggagccgtgggctgtggagggtttgtgtatgatgagaagccctgtacagtcttgtcaagaaataccctgagccagtctctgagacgcttcggtaaaaaatgtccctggatggaatcaagattttaaattcaaataaagcctaatatcatgttgtgtccacattaaaaaaaaacaacaca

SEQ ID NO: 349655 - DNA, 2749 bp, Homo sapiens
ttcagttgtatttactgtgtccctgtggctgtcaatatcacataggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacggtaagtgtgggctggggtccgcggcggcgacagcggcggcggcggccggggatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgt

SEQ ID NO: 349656 - DNA, 3002 bp, Homo sapiens
ttcagttgtatttactgtgtccctgtggctgtcaatatcacataggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgtgtgccttatgaaatgctgggatctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349657 - DNA, 3279 bp, Homo sapiens
ttcagttgtatttactgtgtccctgtggctgtcaatatcacataggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgtgtgccttatgaaatgctgggatctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatgtacagccacctttcgtaaaactttacctctctactttctaccccccttgttagacgagacctctcctgcctggaggggcctctagtgcgcgtggtgccttagcggggccaccagtaattgcctgaatgacacagacactagcaacttccatttttaagagtgtagcagtgagagagaaaccttttttgtttttgagaatttgaatgctgtgaacttgcaggagctgccaaccccctgccctccagattctcatgcccaatttcttttctctcctagatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349658 - DNA, 2010 bp, Homo sapiens
cagcagaggcaggtcatcttcctgagcgtttgtggcgctcctcttaaagataatgtccgagttttctttacatacctgtagctgtttttacttttctgtttttgaagtcagtttgtgtcttgacgtgtcccttgcaatatccctatcgttatatatgctgtgtgccttatgaaatgctgggatctggaaaatccaaccaaccaacccaccggctcctcaccgtctccacctctgcctttgactgacacctcaatctgtcaatcggaaccgcctaccatgcgattggtcggatggcgtttcggggggcggtgcatgcagagaagccaacagagcagtaagcgcagcagccggagtgtggaagatgacaaggagggtcacctggtgtgccggatcggcgattggctccaagagcgatgtacagccacctttcgtaaaactttacctctctactttctaccccccttgttagacgagacctctcctgcctggaggggcctctagtgcgcgtggtgccttagcggggccaccagtaattgcctgaatgacacagacactagcaacttccatttttaagagtgtagcagtgagagagaaaccttttttgtttttgagaatttgaatgctgtgaacttgcaggagctgccaaccccctgccctccagattctcatgcccaatttcttttctctcctagatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349659 - DNA, 1707 bp, Homo sapiens
aaggctggtaccggtctgggatgttaaggcataagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349660 - DNA, 2844 bp, Homo sapiens
ttcagttgtatttactgtgtccctgtggctgtcaatatcacataggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349661 - DNA, 2085 bp, Homo sapiens
cagaccctccctcacaggcctcaggaggaaccaaccctgccgacaccctgacctgaacttcagccttcagaaccaagagacaatgaatgcctgccattgaagctaccgtcttcagcactttgttatcacagccctagcaaactcacagaggggcaactgccagccggtgccagcgtgccttccaatattcagccatctcctcatgaagcctgggatgtgattcttgtgcctctagctctttcctgaggggcactggtacctccaggacctggagtgtactggaagaaatggtgcagtccagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349662 - DNA, 1872 bp, Homo sapiens
tcaggagcaaccgggaagccccagcagccccatggctggaggtggctggctgtgtgtttagcagggctctctgttcctcgtggcctagatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349663 - DNA, 2886 bp, Homo sapiens
ttcagttgtatttactgtgtccctgtggctgtcaatatcacataggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagcaaggacccagctgaccagcgtccccatcccccttttggcagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagaagccaacagagcagtaagcgcagcagccggagtgtggaagatgacaaggagggtcacctggtgtgccggatcggcgattggctccaagagcgatatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349664 - DNA, 2747 bp, Homo sapiens
ttcagttgtatttactgtgtccctgtggctgtcaatatcacataggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349665 - DNA, 2680 bp, Homo sapiens
ttcagttgtatttactgtgtccctgtggctgtcaatatcacataggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgatgcatcactgtaagcgataccgctcccctgaaccagacccgtacctgagctaccgatggaagaggaggaggtcctacagtcgggaacatgaagggagactgcgatacccgtcccgaagggagcctcccccacgaagatctcggtccagaagccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349666 - DNA, 2595 bp, Homo sapiens
ttcagttgtatttactgtgtccctgtggctgtcaatatcacataggcgccacgccctgtcgcttcactgcgcgacgctcgcgaggccggggacgccactcccagaccgggcgggacgcgcacgctcacagtgaggtctcaaaagatccccacctcagttttctcatctggaaagtggggcctcgtaatcctgtccgacccggcgcgggacagtaggtgtcagggattttggtgaccccacgctcgaggcctctgcaaaagggggctgtccagtggcccagagacgcagccggcggggcttttgtctagcgggggagtcttaactgagaggccacgcaggccggcaggaagccgctccacaggagggggctcaaggagaggggatctcctccctccagactccggccccgccagagtagctctagggtatcttcccagaaactgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacaatgcccgtcctctccgcgcgcaggagggagttggcggaccacgcggggtcggggcgacggagcgggcccagccccacggccaggtcggggccccacctctcggctctgagagcccagccggcccgggccgcgcacctgtcaggtcgggggacctacgtgcgccgcgacacggcgggaggcgggccgggccaggctcgtcccctcggccctcccggaactagtctcctaggccgcggcgcccgccggagcggagagggctggtgccccggagccttcgagtcgggggctagagcggccaggcctccgagccgggtcgagccgaggctggcgacggctgcgtcacgcgagggggcggggctgccacgggcggaggtcgcagccggaagcggaagaggcgctcggagcggggagtggggcctagctgcagccggagcctgggagacgccatgaccgcctgccctaccagaggaggtaccgggagcgccgtgacagcgatacataccggtgtgaagagcggagcccatcctttggagaggactactatggaccttcacgttctcgtcatcgtcggcgatcgcgggagagggggccataccggacccgcaagcatgcccaccactgccacaaacgccgcaccaggtcttgtagcagcgcctcctcgatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349667 - DNA, 1432 bp, Homo sapiens
gtgatatagaggatccctatgaaaggcgatctagagagggggccataccggacccgcaagcatgcccaccactgccacaaacgccgcaccaggtcttgtagcagcgcctcctcgatgagattgtggggaacctgggtgaaggcacctttggcaaggtggtggagtgcttggaccatgccagagggaagtctcaggttgccctgaagatcatccgcaacgtgggcaagtaccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacacctttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccagccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagc

SEQ ID NO: 349668 - DNA, 1549 bp, Homo sapiens
agccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttccca

SEQ ID NO: 349669 - DNA, 318 bp, Homo sapiens
cctggcttgctcaggtctcggtgagacctggagtcagtgttactaccccaggatcccgtgaacccagctgagcgtgcctggcctggcttgctcaggcctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccag

SEQ ID NO: 349670 - DNA, 1635 bp, Homo sapiens
agccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttccca

SEQ ID NO: 349671 - DNA, 1521 bp, Homo sapiens
agccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttccca

SEQ ID NO: 349672 - DNA, 1559 bp, Homo sapiens
agccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccag

SEQ ID NO: 349673 - DNA, 1397 bp, Homo sapiens
agccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctactccctgagggcccaggtggtggaggtggggttggagcaggaagggaattttgatttttttttttcttgatagatactaataaaaataaggctgtgtaattttctctcagcc

SEQ ID NO: 349674 - DNA, 595 bp, Homo sapiens
  misc_feature (209)..(211): n is a, c, g, or t
  misc_feature (215)..(215): n is a, c, g, or t
  misc_feature (219)..(219): n is a, c, g, or t
aacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagcaaaaaaaaaaaaaaaaaaaaaaaactcctcgtgccgaattcgnnnagangtcnggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttccca

SEQ ID NO: 349675 - DNA, 1957 bp, Homo sapiens
agccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttcccaaaaaaaaaaaaaagaacaaaaagaaacagaaaaaaaaaaaaaaaaaaaacacaacaaaaaaaaaaagaaacacaacaagccaacacaagaaaataagaaacaaagcgcaacaacaagaggggcgcgccgcgccgcgcctcgacacacacctgcccgctcgggcgcggagcgccaccgacctccccacgccacccaccattgcttctgcaaatagggggctccccccacacagcgggcggaccacgccagcactacgaaagcgaggcgcggaggcagccgggaaaagacgacacaaccggccctccgcgcgggagggctccaccccgccagctgccgggaccccgactggcggacccccgcccaactacgctcgcgcgcccaccacaattgaggcctcaccccacccgt

SEQ ID NO: 349676 - DNA, 1632 bp, Homo sapiens
agccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttcccactctaaagccaccatcctcacgagactctggggccccccaggctcccagacctttgagcaaccttcaccgcacagaaacccag

SEQ ID NO: 349677 - DNA, 1487 bp, Homo sapiens
agccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagccttttagacaaggacaacagcgagggcatcgaggactcaagaatagccctggcactgggctgacgccctcagagtgaaaactgaaggtgtgaaggagacctggcactgttcggtagacgtg

SEQ ID NO: 349678 - DNA, 596 bp, Homo sapiens
ggtactgtggctactgctggagtgtggtacctgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctcaagcacgtagctaacaagaccgacct

SEQ ID NO: 349679 - DNA, 377 bp, Homo sapiens
agcggccgcctactactactaaattcgcggccgcgtcgacgggaggtgagaggtcagctgacatccttcccattccaggtgggtcaccaggcccaaatcaagaagtagctaccaaactccaagaggcagagtcgaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349680 - DNA, 400 bp, Homo sapiens
agcggccgcctactactactaaattcgcggccgcgtcgacgggaggtgagaggtcagctgacatccttcccattccaggtgggtcaccaggcccaaatcaagaagtagctaccaaactccaagaggcagagtcgaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattcaaaaaaaaaagtcgacgcggccgc

SEQ ID NO: 349681 - DNA, 274 bp, Homo sapiens
agcggccgcctactactactaaattcgcggccgcgtcgacgggagggacatatgtgaccccaataattctggagatgacactcctgggtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349682 - DNA, 213 bp, Homo sapiens
ctggactgggaagggacatatgagacgtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349683 - DNA, 139 bp, Homo sapiens
  misc_feature (123)..(123): n is a, c, g, or t
tgatctagaggatcttagttactggatgtcagctgacctctcacctcccatgggcagagaagaaaatgaccaggagtgtcatctccagaattattggggtcacatatgtcccttcccaccccnaaaaaaaaaagggggg

SEQ ID NO: 349684 - DNA, 1902 bp, Homo sapiens
gctagtagagccgtgtgttgaatcggccgagggtggttggtgcggcggttcggagctttggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349685 - DNA, 1540 bp, Homo sapiens
tcccacaaatgagcatgagtgcgtgctcgatgtttaaatcggccgaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349686 - DNA, 1950 bp, Homo sapiens
gctagtagagccgtgtgttgaatcggccgagggtggttggtgcggcggttcggagctttggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattcaaaaaaaaaaaagtcgacgcggccgcgaatttagtagtagtagtcgacc

SEQ ID NO: 349687 - DNA, 2092 bp, Homo sapiens
gctagtagagccgtgtgttgaatcggccgagggtggttggtgcggcggttcggagctttggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattcaaaaaaaaaaaaaaaaaaaaaaaaaaaaaaaaaaaaaaaaaaaaaaaaaaaaaaaaaaaggggggggcgcgcaaaataccccccggcggagggggcccacattactgcgcgccccccacgttcttttgtcgcaacaaggggcgccccccaataagaaggacgagcccataatataacacccagagacgccg

SEQ ID NO: 349688 - DNA, 1981 bp, Homo sapiens
gccctctcatcctgccctccggcccctctgcagctatgaggtcctccgtctctcggcaaacatactccacaaaagggggcttcagctccaactctgccagcggagggagtgggtcccaggcccgcaccagcttcagctcagtgacggtgtctcggagcagtggcagtggtggcggggcccactgtggccccggcacaggtggctttggcagccgaagcctctataacttggggggccacaagagtatctctgtcagtgtggccggaggggccttgtcggggcgggctctggggggctttggctttggcagcagggcatttatgggacagggggctggcaggcagacgtttgggcctgcttgtcctcctggggggatccaggaggtcactgtcaaccagagcctgctgacccccctccatgtggagattgaccccgagatccagcgagtgcgcactcaggagcgggagcagatcaagaccctcaacaacaagttcgcctccttcatcgacaaggtgcggttcctggagcaacagaataaggtgctggagaccaagtgggcactgctgcaggagcagggccagaacttgggtgtcaccaggaacaacctggagcccctctttgaggcctacctgggtagcatgcggagcacgctggacagacttcagagcgagcgggggaggctggactcagagctcaggaacgtgcaggaccttgtggaggacttcaagaacaagtacgaggatgaaatcaacaagcacactgctgcagagaacgagtttgtggtgctcaagaaggatgtggatgcagcatacatgggccggatggatctgcatggcaaagtgggcaccttgacccaggagattgacttcctgcagcaactctatgaaatggagctgagccaagtgcagacccacgtgtctaacaccaatgtggtgctgtccatggacaacaaccgcaacctggacctggacagcatcatcgccgaggtcaaggcccagtatgagctgattgcccagaggagccgggctgaggccgaggcctggtaccagaccaagtatgaggagctgcaggtgactgctgggaagcatggggacaacctgcgggacaccaagaacgagattgctgagctcacccgcactatccagaggcttcagggggaggctgatgcagccaagaagcagtgtcagcagctgcagacggccattgcggaagcggagcagcgtggggagctggcactcaaggatgctcagaagaagcttggggatctggatgtggccctgcaccaggccaaggaggacctgacacggctgctgcgtgactaccaggagctgatgaatgtcaagctggccctggacgtggagattgccacctaccgcaagcttctggagagcgaggagagcaggatgtctggagaatgtcccagtgcagtcagcatttctgtgactggcaactccaccactgtgtgcggaggtggcgcagccagctttggaggtggcatctccctgggtgggagtgggggggccaccaagggtggattcagcacaaatgtgggctatagcaccgtcaagggagggccagtctctgcgggcacctccatcctgcggaagaccactacggtcaagacgtccagccagaggtattagctgctgagccctgcaagggcccctgcaatcctgtccctgccctcctcaccccacctctgctgtcctttccagtcacttctcaggagcaggaacagccaggggacctcagacccagggtattttcataccagactatttgcatcttgggaagcgctcaaatctactcaggttttctccttggtcctgcagtaggatgggagggaaggttaaagttgccagcttgagtgatgtgcttggggtgacttgggggtgaccttttgaccaccgagaggaggctgaatttctcaagccattaggagagagagaaattgggaagtggtcccaaagacccttcaacc

SEQ ID NO: 349689 - DNA, 791 bp, Homo sapiens
gcgtcgactttttttttttgaatgacaaaagcattttattgaagattcacctgcagatggataagagggaatgagaggagtagaatgggacactaagtggttctcatcctaagcttgcagggccaagtgctgccgggtgttggagaagtagtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349690 - DNA, 529 bp, Homo sapiens
gcgtcgaccaccagtgctgggcccagctggacacagtgagctgcagggacctcgtctggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349691 - DNA, 2248 bp, Homo sapiens
gccctctcatcctgccctccggcccctctgcagctatgaggtcctccgtctctcggcaaacatactccacaaaagggggcttcagctccaactctgccagcggagggagtgggtcccaggcccgcaccagcttcagctcagtgacggtgtctcggagcagtggcagtggtggcggggcccactgtggccccggcacaggtggctttggcagccgaagcctctataacttggggggccacaagagtatctctgtcagtgtggccggaggggccttgtcggggcgggctctggggggctttggctttggcagcagggcatttatgggacagggggctggcaggcagacgtttgggcctgcttgtcctcctggggggatccaggaggtcactgtcaaccagagcctgctgacccccctccatgtggagattgaccccgagatccagcgagtgcgcactcaggagcgggagcagatcaagaccctcaacaacaagttcgcctccttcatcgacaaggtgcggttcctggagcaacagaataaggtgctggagaccaagtgggcactgctgcaggagcagggccagaacttgggtgtcaccaggaacaacctggagcccctctttgaggcctacctgggtagcatgcggagcacgctggacagacttcagagcgagcgggggaggctggactcagagctcaggaacgtgcaggaccttgtggaggacttcaagaacaagtacgaggatgaaatcaacaagcacactgctgcagagaacgagtttgtggtgctcaagaaggatgtggatgcagcatacatgggccggatggatctgcatggcaaagtgggcaccttgacccaggagattgacttcctgcagcaactctatgaaatggagctgagccaagtgcagacccacgtgtctaacaccaatgtggtgctgtccatggacaacaaccgcaacctggacctggacagcatcatcgccgaggtcaaggcccagtatgagctgattgcccagaggagccgggctgaggccgaggcctggtaccagaccaagtatgaggagctgcaggtgactgctgggaagcatggggacaacctgcgggacaccaagaacgagattgctgagctcacccgcactatccagaggcttcagggggaggctgatgcagccaagaagcagtgtcagcagctgcagacggccattgcggaagcggagcagcgtggggagctggcactcaaggatgctcagaagaagcttggggatctggatgtggccctgcaccaggccaaggaggacctgacacggctgctgcgtgactaccaggagctgatgaatgtcaagctggccctggacgtggagattgccacctaccgcaagcttctggagagcgaggagagcaggatgtctggagaatgtcccagtgcagtcagcatttgtgagtatttactccccacttcctgctccacccctggccaggccccagaactctgctcagtttatgcaacctgtacctgtcctaaagcatgctctcctccattcgagcccctggagacaggttcagagggtcctagttctgggcttctctatccatttcccatagctctgctgcttgattttgttctgattccccactgatttctgggtctcccccagccctctctggcatggccgccctgactaatccagaccctttgctttgcagctgtgactggcaactccaccactgtgtgcggaggtggcgcagccagctttggaggtggcatctccctgggtgggagtgggggggccaccaagggtggattcagcacaaatgtgggctatagcaccgtcaagggagggccagtctctgcgggcacctccatcctgcggaagaccactacggtcaagacgtccagccagaggtattagctgctgagccctgcaagggcccctgcaatcctgtccctgccctcctcaccccacctctgctgtcctttccagtcacttctcaggagcaggaacagccaggggacctcagacccagggtattttcataccagactatttgcatcttgggaagcgctcaaatctactcaggttttctccttggtcctgcagtaggatgggagggaaggttaaagttgccagcttgagtgatgtgcttggggtgacttgggggtgaccttttgaccaccgagaggaggctgaatttctcaagccattaggagagagagaaattgggaagtggtcccaaagacccttcaacc

SEQ ID NO: 349692 - DNA, 1589 bp, Homo sapiens
gggataactgactgctctcccggcctttctgtgtcccctaggatgtctggagaatgtcccagtgcagtcagcatttgtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgagccaagtgcagacccacgtgtctaacaccaatgtggtgctgtccatggacaacaaccgcaacctggacctggacagcatcatcgccgaggtcaaggcccagtatgagctgattgcccagaggagccgggctgaggccgaggcctggtaccagaccaagccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcggagcagcgtggggagctggcactcaaggatgctcagaagaagcttggggatctggatgtggccctgcaccaggccaaggaggacctgacacggctgctgcgtgactaccaggagctgatgaatgtcaagctggccctggacgtggagattgccacctaccgcaagcttctggagagcgaggagagcaggatgtctggagaatgtcccagtgcagtcagcatttgtgagtatttactccccacttcctgctccacccctggccaggccccagaactctgctcagtttatgcaacctgtacctgtcctaaagcatgctctcctccattcgagcccctggagacaggttcagagggtcctagttctgggcttctctatccatttcccatagctctgctgcttgattttgttctgattccccactgatttctgggtctcccccagccctctctggcatggccgccctgactaatccagaccctttgctttgcagctgtgactggcaactccaccactgtgtgcggaggtggcgcagccagctttggaggtggcatctccctgggtgggagtgggggggccaccaagggtggattcagcacaaatgtgggctatagcaccgtcaagggagggccagtctctgcgggcacctccatcctgcggaagaccactacggtcaagacgtccagccagaggtattagctgctgagccctgcaagggcccctgcaatcctgtccctgccctcctcaccccacctctgctgtcctttccagtcacttctcaggagcaggaacagccaggggacctcagacccagggtattttcataccagactatttgcatcttgggaagcgctcaaatctactcaggttttctccttggtcctgcagtaggatgggagggaaggttaaagttgccagcttgagtgatgtgcttggggtgacttgggggtgaccttttgaccaccgagaggaggctgaatttctcaagccattaggagagagagaaattgggaagtggtcccaaagacccttcaacc

SEQ ID NO: 349693 - DNA, 312 bp, Homo sapiens
tgcccagaggagcaaggctgaggctgaagccctgtaccagaccaaggtgggtggtatggatctctcaggagatggggctggctctggggctctgcttttgatgtctgtgaacaggtgatcattagctcaagcccaatagaagtcagatatgaacagactctcccaggcatcgttggtcctggtctgatttgaaactacttgacatttggtgctattcttgccacctgtggcaattctcactgagttcacttgagaatggaccctacccaaatgcccctaacacctggttctctgtgtcttcttgagtcttag

SEQ ID NO: 349694 - DNA, 2186 bp, Homo sapiens
agcactcaccggcctgggccctgtcacttctctgatagctcccagctcgctctctgcagccatgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcagaagcctctacaacctcagggggaacaaaagcatctccatgagtgtggctgggtcacgacaaggtgcctgctttgggggtgctggaggctggcactggtggctttggtgccggcggcttcggagctggtttcttggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349695 - DNA, 417 bp, Homo sapiens
agcggccgcctactactactaaattcgcggccgcgtcgacgggagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattcaaaaaaaaaaaagtcgacgcggccgcgaatttagtagtagtagtcgacc

SEQ ID NO: 349696 - DNA, 2144 bp, Homo sapiens
agcactcaccggcctgggccctgtcacttctctgatagctcccagctcgctctctgcagccatgattgccagacagcagtgtgtccgaggcgggccccggggcttcagctgtggctcggccattgtaggcggtggcaagagaggtgccttcagctcagtctccatgtctggaggtgctggccgatgctcttctgggggatttggcagcagaagcctctacaacctcagggggaacaaaagcatctccatgagtgtggctgggtcacgacaaggtgcctgctttgggggtgctggaggctttggcactggtggctttggtggtggatttgggggctccttcagtggtaagggtggccctggcttccccgtctgccccgctgggggaattcaggaggtcaccatcaaccagagcttgctcacccccctccacgtggagattgaccctgagatccagaaagtccggacggaagagcgcgaacagatcaagctcctcaacaacaagtttgcctccttcatcgacaaggtgcagttcttagagcaacagaataaggtcctggagaccaaatggaacctgctccagcagcagacgaccaccacctccagcaaaaaccttgagcccctctttgagacctacctcagtgtcctgaggaagcagctagataccttgggcaatgacaaagggcgcctgcagtctgagctgaagaccatgcaggacagcgtggaggacttcaagactaagtatgaagaggagatcaacaaacgcacagcagccgagaatgactttgtggtcctaaagaaggacgtggatgctgcctacctgaacaaggtggagttggaggccaaggtggacagtcttaatgacgagatcaacttcctgaaggtcctctatgatgcggagctgtcccagatgcagacccatgtcagcgacacgtccgtggtcctttccatggacaacaaccgcaacctggacctggacagcattattgccgaggtccgtgcccagtacgaggagattgcccagaggagcaaggctgaggctgaagccctgtaccagaccaaggtccagcagctccagatctcggttgaccaacatggtgacaacctgaagaacaccaagagtgaaattgcagagctcaacaggatgatccagaggctgcgggcagagatcgagaacatcaagaagcagtgccagactcttcaggtatccgtggctgatgcagagcagcgaggtgagaatgcccttaaagatgcccacagcaagcgcgtagagctggaggctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349697 - DNA, 908 bp, Homo sapiens
tgctagagaggccgtgttaaatcggacgaggccatgaggagctgccctgcagcaggccaaggaggagctggcacgaatgctgcgtgagtaccaggagctcatgagtgtgaagctggccttggacatcgagatcgccacctaccgcaaactgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349698 - DNA, 790 bp, Homo sapiens
ggtactgtggctactgctggagtgtggtacctgctggagggcgaggagtacagaatgtctggagaatgccagagtgccgtgagcatctctgtggtcagcggtagcaccagcactggaggcatcagcggaggattaggaagtggctccgggtttggcctgagtagtggctttggctccggctctggaagtggctttgggtttggtggcagtgtctctggcagttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349699 - DNA, 603 bp, Homo sapiens
tctcataggttcgcaggactacctgggatcgaggttccagcagcaagatcatctctaccaccaccctgaacaagagacgatagaggagacgaggtccctgcagctcactgtgtccagctgggcccagcactggtgtctctgtgcttccttcacttcacctccatcctctgtctctggggctcatcttactagtatcccctccactatcccatgggctctctctgccccaggatgatcttctgtgctgggacagggactctgcctcttggagtttggtagctacttcttgatttgggcctggtgacccacctggaatgggaaggatgtcagctgacctctcacctcccatgggcagagaagaaaatgaccaggagtgtcatctccagaattattggggtcacatatgtcccttcccagtccaatgccatctcccactagatcctgtattatccatctacatcagaaccaaactacttctccaacacccggcagcacttggccctgcaagcttaggatgagaaccacttagtgtcccattctactcctctcattccctcttatccatctgcaggtgaatcttcaataaaatgcttttgtcattca

SEQ ID NO: 349700 - DNA, 887 bp, Homo sapiens
ggaacttcctcttccaccagcagatttcaccagcagtggaagctttggaaaaaaaaatccaccatctctgtccttaggaaaagcatgaaatagaaagtgggcagaaactaggcagctctgtctggtcgtgggcttgtttccattggggcagggatgctgtccgtagcccacatgggcagagaggaaagaaaaggggaggatgggagttggcacagcctactggtggctctgcactttctgcagcactggcttttggacctgggcacagccctatacacatacttctcatgtttcctggtcttgtcatcaggattcactgagtggatccaatgtaaaggcagagggaaggagagggttttcatgtgggcaccagggataactgactgctctcccggcctttctgtgtcccctaggatgtctggagaatgtcccagtgcagtcagcatttgtgagtatttactccccacttcctgctccacccctggccaggccccagaactctgctcagtttatgcaacctgtacctgtcctaaagcatgctctcctccattcgagcccctggagacaggttcagagggtcctagttctgggcttctctatccatttcccatagctctgctgcttgattttgttctgattccccactgatttctgggtctcccccagccctctctggcatggccgccctgactaatccagaccctttgctttgcagctgtgactggcaactccaccactgtgtgcggaggtggcgcagccagctttggaggtggcatctccctgggtgggagtgggggggccaccaagggtggattcagcacaaatgtgggctatagcaccgtcaagggagggccagtctctgcgggcacctccatcctgcggaagac

SEQ ID NO: 349701 - DNA, 1912 bp, Homo sapiens
  misc_feature (1905)..(1905): n is a, c, g, or t
  misc_feature (1907)..(1912): n is a, c, g, or t
tggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttaggctccgtcaanannnnnn

SEQ ID NO: 349702 - DNA, 203 bp, Homo sapiens
actcattaaacaagatgatgaccttgaagttcccgcctatgaagacatcttcagggatgaagaggaggatgaagagcattcaggaaatgacagtgatgggtcagagccttctgagaagcgcacacggttagaagaggtgagtttgggtctctcacagctatcccagaggaacttgcactcccagaggtcggaggtcatcctga

SEQ ID NO: 349703 - DNA, 935 bp, Homo sapiens
tggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctg

SEQ ID NO: 349704 - DNA, 468 bp, Homo sapiens
atcctttcattagtagcaacatggataaaattggaagtcattatgttaagtgaaataaaccatgaacagaaatacaaatatatcatgttctcactggtatgcaggagctaaaaaaagtggatcttatgaaggtcaagggtagtgggcatctccaatacgccaaatgtggcctgttccaccacttctctcttcccacatccaggtctggtagagagaagtggtggaacaacaggccacatttggcgcattggagatgaaattcttggttgaaaattcttttctttaagaatgttgaatattggcccccactctcttctggcttgtagggtttctgcagagagatatgctgttagtctgatgggcttccctttataggtaacctgacccttctctctggctgcccttaactttttttccttcatttcaagcttggagaatctgacaattacgtttcttggggttgctttt

SEQ ID NO: 349705 - DNA, 544 bp, Homo sapiens
tatgcttttataaaattgagcttagactctatttttattttacaaatattccacttaatagtgcatgaacttaactgcagacaaagagacagaaacagaaatgaaggaattcctgaactccctagcacagttagaaagacatttgtctaaacgactcctctaagggcaaacatacattaaattaaggagaagacattaagatttggagtggttttcttattcctttttacaaccaagttaaggtgtgagttgcctatggtacaatgcatccatttcaagtttgatgactattactctaaaaggtcctcttgtgccctttgcagtcagtcccgccctccccctggccccagcaattaatgatgtattttctgtcactatacaggttagttttacctgttctagaaattcaccttgatggcgccacacaggatgccctcttttcatcactcggcatgatgtttttgaggtaatccatgctatctcatgtttctgtaatgtgtcccattttattgctgggtagttggggtagatcgccgacacattc

SEQ ID NO: 349706 - DNA, 1102 bp, Homo sapiens
tatgcttttataaaattgagcttagactctatttttattttacaaatattccacttaatagtgcatgaacttaactgcagacaaagagacagaaacagaaatgaaggaattcctgaactccctagcacagttagaaagacatttgtctaaacgactcctctaagggcaaacatacattaaattaaggagaagacattaagatttggagtggttttcttattcctttttacaaccaagttaaggtgtgagttgcctatggtacaatgcatccatttcaagtttgatgactattactctaaaaggtcctcttgtgccctttgcagtcagtcccgccctccccctggccccagcaattaatgatgtattttctgtcactatacaggttagttttacctgttctagaaattcaccttgatggcgccacacaggatgccctcttttcatcactcggcatgatgtttttgagccaaatttctcccatttgggttaatcgcaggatcagcacgtccacagtgcaatggaaaagcaacgccctgggaaaacaaccttcataacgtcctctgcgatgccaggtttgatcggccagtggcagtatctttggaaactttcatatttaccaggcatgaagaatctttctcatttcaattggacctttatcaccagcccaagggagaggaaagtcctaacgcatatcaagttctgagctggccaggacttagtcagtatctactgaaaccttgaatatcttggctgtgttaactgttttgacccaacatggagcgaaaatgttggttgtaccttgagattctgacatctggttgaagtccaggttcactggcccaggacaggtcattcagctgtttgaaaaaaaacagaagagagaccaggccatccactgaggtaatctccatgcagcatgaaccactggttccaatgaacccaccatcaccatacttctcaggaatcgctggtcactagactgagagttctgtgaaagctgagatcatatcttactaatctctgtgttcatggttcccagctcagggtctagcactgagggagttctcaggagagtgttcatcaattattgaataaaaagcga

SEQ ID NO: 349707 - DNA, 1593 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349708 - DNA, 908 bp, Homo sapiens
  misc_feature (17)..(17): n is a, c, g, or t
tcggcttggtacgcctncgggtatgggatggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgaaaccacgaaagagaacacacacaaagaaagcttgacggggggattatggccatgaatacgccgggatgtgacacacaacccagacatacgttttgtctcataagcccataaagagttttcctataaccggacagttggaacccgaaaaattgggcgctcctaaattgacg

SEQ ID NO: 349709 - DNA, 520 bp, Homo sapiens
tgagacggagtttcgctctttgttgcccaggctggagtgcaatggtgcaatctcagctcactgcaacctctgcctcgcaggttcaagccattctcctgcctcagcctcccaagtagctgggattacaggcatgtaccaccacgcccagctaattttgtatttttggtagagacgtggtttctccatgttggccaggctggtctcgaactcccgacctcaggtgatccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349710 - DNA, 988 bp, Homo sapiens
agcccgtggggctgaggaggggaaggctaaaacccacccactctcgggagcagcaagtgctgggaaggcccagggttgtcttggggtgaggggaggcatgggcataggatgaggcccagggcagtgcactgaccttacgctgctccctcgtgtcctggacacctggctgccgttccctccctccctctctcctgctgctcctcttcccaaggcctcccatttgttgtgtaaaatgcagtgtttacctggccagctcccgcccctgttcctacttccacctggccttgactgttggtcctgaaccttgttttctgatgaccacacttgatcactctgaggttcctagctgttgtacctggagtgcagttgggaggacacccggttcccaacaccatctggtcacaccatgttcctcagggccaagggaggagcagagaggctggcctctagggagaaggggtggggaagctcaggcacctcccagtttgtcctgaaggcagggatcggggcaattggtacagtagtgatgacaattgtatgtattcaaattgtatgctttaacttttactattaccacactcttgtgaggtgtgctgttaacctcattgtgtagaggagaaaacaggctagagtcaagtgatatgcttggagtcaggtgaccttggagtcaaggtcctgctgttaaggagtggtatagctgggacgcagacactggcgttcagattacaaatccatggtacttccactctccacagctgccagggcctcttcccccaacccctggcactgacagtgtgagttgtatcgaactggtttagtttcttggccttaacctgtcaccaccaccaagattctttttgttttgttttgttttgtttttttggggcggaattgcactccagcctgagtaacagactgagaccctgtctcaaaaaacaaaatgagacaaaaaacctgctcgtaataaagtgtgaaattataaaaagaa

SEQ ID NO: 349711 - DNA, 1887 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgaaaccacgaaagagaacacacacaaagaaagcttgacggggggattatggccatgaatacgccgggatgtgacacacaacccagacatacgttttgtctcataagcccataaagagttttcctataaccggacagttggaacccgaaaaattgggcgctcctaaattgacg

SEQ ID NO: 349712 - DNA, 1753 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgagatttctgagtcctctgcagccctcagaggtgccct

SEQ ID NO: 349713 - DNA, 1473 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtctgagaccctcatctctaaaaagcgaataaaaacagaaaaaacaccaaaacaaccaggatgtctcccatttgcactccacttaagtgtggagacttaggctgatcacatcactgcactccagcctgagtaacagactgagaccctgtctcaaaaaacaaaatgagacaaaaaacctgctcgtaataaagtgtgaaattataaaaagaa

SEQ ID NO: 349714 - DNA, 1779 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtccatttcagatcccccagaccagatgacctatcttccttccagctctgagtcacttcccattgggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349715 - DNA, 1336 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccaccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349716 - DNA, 1528 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggagaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349717 - DNA, 1876 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtctaggaaaggatgcccacctggatctgttttgctgggagctggcctcccattagactcatgtgcactcagtgggctgtgctacctccctcccccagtgtgtaaatatgttgctgtggagctgaagtcagcctttgaggaaaccggcaagaccaaggaggtgattggcacgggctatggcatcctggaccagaaggcctctggagtcaaatacaccaagtccatttcagatcccccagaccagatgacctatcttccttccagctctgagtcacttcccattgggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349718 - DNA, 1655 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagcatttcagatcccccagaccagatgacctatcttccttccagctctgagtcacttcccattgggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349719 - DNA, 1322 bp, Homo sapiens
ctacataataacagcaaaatctattttcccttccaaagttcccttcatatcccaactatccacttccaaaacccggcagcagcagcagcagcagcagcagcaagggaagaagcagaagacagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349720 - DNA, 1255 bp, Homo sapiens
tagacgatcgcttaaagacgacagaagggcaaggcagcagggtaagggagtagcagcagcaaacaaaggaaggagctgggtggccttgagggagaccccagctctgagtcacttcccattggtgagatgtgcaggtgttggggcacagggctggagggacagaccactaacccactgcggctaggaggggaactcagttcctcatcctcctgtcttggcagggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349721 - DNA, 2092 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaaggttggattcgggattgtccttcatccgctctggggtcaggcctgcatgtatcttagtgtgtctgctggtgtgagtgtgatttgaagatgaccacctggggatcttccttcattgcctcttcccattctttgattgccgtttgtgctcctcccctcttgagtggcctcatttttcaggcacatgcatgagggtctgggcctgttcatgagggtcctgcttcaatctcagacacaggcagaaatgctccacagttgctgcccccgtgggaacctaaagacactagaacggggagaactcagcaagatccacgatgtgcagaaaggtgggggtttaggcgaggtgtcagaggacacctcggtgggagtgactgcccagtcccatctctgggtccacacagcacctcccacaaccccgctgggatgcccttgtgatggcccatgtactcagtatgtgtacgagtgcttttctctctggagaatgagctgcttacaacaaggcccatagttcttactctctacatcttcagtgcctggcacagggtaagatagttgccacccacatttttctacctaagtttccttctagcaaaggataccattcataaactcctgggatacctaagggaatagtctcaagcagcagaaatttgtatgaattttgcactcagtaataaatctgtgtttgctttaataaaaagtgtttaagaattatttttcaaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349722 - DNA, 1470 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagggacttgcggttaatcgaagtcactgagaccatttgcaagaggctcctggattatagcctgcacaaggagaggaccggcagcaatcgatttgccaagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349723 - DNA, 1968 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagggacttgcggttaatcgaagtcactgagaccatttgcaagaggctcctggattatagcctgcacaaggagaggaccggcagcaatcgatttgccaaggttggattcgggattgtccttcatccgctctggggtcaggcctgcatgtatcttagtgtgtctgctggtgtgagtgtgatttgaagatgaccacctggggatcttccttcattgcctcttcccattctttgattgccgtttgtgctcctcccctcttgagtggcctcatttttcaggcacatgcatgagggtctgggcctgttcatgagggtcctgcttcaatctcagacacaggcagaaatgctccacagttgctgcccccgtgggaacctaaagacactagaacggggagaactcagcaagatccacgatgtgcagaaaggtgggggtttaggcgaggtgtcagaggacacctcggtgggagtgactgcccagtcccatctctgggtccacacagcacctcccacaaccccgctgggatgcccttgtgatggcccatgtactcagtatgtgtacgagtgcttttctctctggagaatgagctgcttacaacaaggcccatagttcttactctctacatcttcagtgcctggcacagggtaagatagttgccacccacatttttctacctaagtttccttctagcaaaggataccattcataaactcctgggatacctaagggaatagtctcaagcagcagaaatttgtatgaattttgcactcagtaataaatctgtgtttgctttaataaaaagtgtttaagaattatttttcaaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349724 - DNA, 2004 bp, Homo sapiens
ctgcctcaacctcctgaatagctgggattacaggcacctgccatcatgcccgggtaatttttgtatttttgtagagactgggtttcaccatgttggccaggttggtcttgaactcctgacctcaggtgatcctcccacctcagccttccaaattgctgggattacaggtgtgagccaccacacccggccacagtgcaattttttaaaacattagtaacaggattaccagctttttattttgctaggtacaaatatagtttttaaaaacccaattctgtcagctgtgatcatcctttcaaagagaatgatattttactatcaaaatttaataattttgctttatcaaaaaatctaaatactgaatcatttagctttataaaaaattccttcccttagagctgttaaaattttgtctctctggtctgtgttccagcatttcagatcccccagaccagatgacctatcttccttccagctctgagtcacttcccattggtgagatgtgcaggtgttggggcacagggctggagggacagaccactaacccactgcggctaggaggggaactcagttcctcatcctcctgtcttggcagggacttgcggttaatcgaagtcactgagaccatttgcaagaggctcctggattatagcctgcacaaggagaggaccggcagcaatcgatttgccaaggttggattcgggattgtccttcatccgctctggggtcaggcctgcatgtatcttagtgtgtctgctggtgtgagtgtgatttgaagatgaccacctggggatcttccttcattgcctcttcccattctttgattgccgtttgtgctcctcccctcttgagtggcctcatttttcaggcacatgcatgagggtctgggcctgttcatgagggtcctgcttcaatctcagacacaggcagaaatgctccacagttgctgcccccgtgggaacctaaagacactagaacggggagaactcagcaagatccacgatgtgcagaaaggtgggggtttaggcgaggtgtcagaggacacctcggtgggagtgactgcccagtcccatctctgggtccacacagcacctcccacaaccccgctgggatgcccttgtgatggcccatgtactcagtatgtgtacgagtgcttttctctctggagaatgagctgcttacaacaaggcccatagttcttactctctacatcttcagtgcctggcacagggtaagatagttgccacccacatttttctacctaagtttccttctagcaaaggataccattcataaactcctgggatacctaagggaatagtctcaagcagcagaaatttgtatgaattttgcactcagtaataaatctgtgtttgctttaataaaaagtgtttaagaattatttttcaaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349725 - DNA, 738 bp, Homo sapiens
  misc_feature (17)..(17): n is a, c, g, or t
tcggcttggtacgcctncgggtatgggatggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349726 - DNA, 1299 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagcaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349727 - DNA, 1241 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtccatttcagatcccccagaccagatgacctatcttccttccagctctgagtcacttcccattgggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349728 - DNA, 723 bp, Homo sapiens
cagtgttgtcactgctttgctctttgacctgtggttactgcttcccaagggccaggcttgttgcatactcactagctttcacgcagcccacccagcagcagcttactctggccctgcctagaaaggcagaatgcaggaaacctggctttccgggtttttttctttccctttttttttttttttggtagagacggggttttgctgtgttgcccaggctggtctcacacttctgggctccagcaatccccccacctcggcctcccaaagttttggaattacaggtgtgtggcttagcgcccagcccaggtttttcttttcttctccccaccacacaagcctttccgaacttgggcgttgcctcccactttcctataccccttcccatccatggcttgtttttgttttgattcagaacacaagccatgtgcagtgcatgcctgtagtcccagctacttgggaggtggcttgagaggatcacttgagcccaggagttccagtccagcctgagcaacacagtgagaccctcatctctaaaaagcgaataaaaacagaaaaaacaccaaaacaaccaggatgtctcccatttgcactccacttaagtgtggagacttaggctgatcacatcactgcactccagcctgagtaacagactgagaccctgtctcaaaaaacaaaatgagacaaaaaacctgctcgtaataaagtgtgaaattataaaaagaa

SEQ ID NO: 349729 - DNA, 430 bp, Homo sapiens
ggtagagacggggttttgctgtgttgcccaggctggtctcacacttctgggctccagcaatccccccacctcggcctcccaaagttttggaattacaggtgtgtggcttagcgcccagcccaggtttttcttttcttctccccaccacacaagcctttccgaacttgggcgttgcctcccactttcctataccccttcccatccatggcttgtttttgttttgattcagaacaggcagaaattaatctacctgatatacagaaattcatatagatgaatttctacctgttctgaatcaaaacacaagccatgtgcagtgcatgcctgtagtcccagctacttgggaggtggcttgagaggatcacttgagcccaggagttccagtccagcctgagcaacacagtgagaccctcatctctaaaaagcgaat

SEQ ID NO: 349730 - DNA, 263 bp, Homo sapiens
ttggcaagacatggtgaagtaagagtcactgaaaccaggtgcagaatgatgggcagacaagtcagatgcccccagaggggcctggtggccacagcgagaggcaggaggcagggaggctgatgtcaagcacagtcccagttgctactcccacggctccctgctcagtgctccttgcccagcaccccagccctgaggcacttctgttgagggtctctctcctccacaccctaggttgcctggcagagcagtggtccggcaagaag

SEQ ID NO: 349731 - DNA, 1717 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349732 - DNA, 412 bp, Homo sapiens
gctttgacctcaagcactcagatattttcccaaatgattcattccacatccgtcctggcccgcgggccagtacggatgtggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcgacttgccggtttcctcaaagtcagaaagctcagcatcatcagcggttggagagaggtccctctgggacagccgagcctcactgagccgccgctcctgctccacctcatcctgggcctggtcatggctggcgttcagtccagcgctccacatccgtactgacc

SEQ ID NO: 349733 - DNA, 1872 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgatgaaaaaaaagagagaagcaaagaaaaaagggggggtagattaccggggggggacacggccctgttaaaggcgcgaggagggtaagagggggggaaaaaggagaagatggtgggcgctggggtagggcaccaaggggaggtgggtgtgtgagagc

SEQ ID NO: 349734 - DNA, 1721 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgttcgattaagcactctccagcctctcaccgcactcatgaaaccccaataaatatcctcattgacaaca

SEQ ID NO: 349735 - DNA, 1479 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349736 - DNA, 1879 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtccatttcagatcccccagaccagatgacctatcttccttccagctctgagtcacttcccattggtgagatgtgcaggtgttggggcacagggctggagggacagaccactaacccactgcggctaggaggggaactcagttcctcatcctcctgtcttggcagggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349737 - DNA, 1171 bp, Homo sapiens
gagctctgcagggtgtcttccttccttgaacaggcttgcgccgggacgctgcggcggacgagagatctggtcccgcatttcagatcccccagaccagatgacctatcttccttccagctctgagtcacttcccattgggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349738 - DNA, 1132 bp, Homo sapiens
gagctctgcagggtgtcttccttccttgaacaggcttgcgccgggacgctgcggcggacgagagatctggtcccggtacccctggagttcacacattgggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349739 - DNA, 2154 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtccatttcagatcccccagaccagatgacctatcttccttccagctctgagtcacttcccattgggacttgcggttaatcgaagtcactgagaccatttgcaagaggctcctggattatagcctgcacaaggagaggaccggcagcaatcgatttgccaaggttggattcgggattgtccttcatccgctctggggtcaggcctgcatgtatcttagtgtgtctgctggtgtgagtgtgatttgaagatgaccacctggggatcttccttcattgcctcttcccattctttgattgccgtttgtgctcctcccctcttgagtggcctcatttttcaggcacatgcatgagggtctgggcctgttcatgagggtcctgcttcaatctcagacacaggcagaaatgctccacagttgctgcccccgtgggaacctaaagacactagaacggggagaactcagcaagatccacgatgtgcagaaaggtgggggtttaggcgaggtgtcagaggacacctcggtgggagtgactgcccagtcccatctctgggtccacacagcacctcccacaaccccgctgggatgcccttgtgatggcccatgtactcagtatgtgtacgagtgcttttctctctggagaatgagctgcttacaacaaggcccatagttcttactctctacatcttcagtgcctggcacagggtaagatagttgccacccacatttttctacctaagtttccttctagcaaaggataccattcataaactcctgggatacctaagggaatagtctcaagcagcagaaatttgtatgaattttgcactcagtaataaatctgtgtttgctttaataaaaagtgtttaagaattatttttcaaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349740 - DNA, 1579 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaaggcttgcgccgggacgctgcggcggacgagagatctggtcccgtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagcaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctga

SEQ ID NO: 349741 - DNA, 1215 bp, Homo sapiens
tgcgcgcctgaatccgtcccacccaggcccagacgcaggcttcttctcctcgggtcttggtcctgcatcctctctctcccagagcctccgttagggggtgggaaaggactttgccataggtcgctgaggccaccatctgctctcttactggccaagggcgtaaaaagatagtcctcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgagatttctgagtcctctgcagccctcagaggtgccct

SEQ ID NO: 349742 - DNA, 558 bp, Homo sapiens
ggggacttgttctctaggtccaggatcttcctaatgcatcgcctcagccatgaacaacgcggagttctttaatacccgcgtctggctccgcagcagaacacgaagtttgcattccccaaggggcggccagggggcggaccagggaaaggtagtcctctgcattttgccgtgtgctggaatggtgtagagtgacgatgaggtggcggtaaggggttgagcgctcacgcgaacgcctaagtgaccagaacgactggtgtgaagccgtgatctgactctgtggagcctgggactggtttcagcgagagcctctgtactgctctgtagtctctgctaggacatggacgaaaagggacgcagccgggagagcgactgccccaggtgggggctggggggacgtaagggaagaataatgattatctggctgtgtttttgtttaaaaaaaaaaaaaaaactggtgtaaatctccatagacttcctatcctcgctcccttcacccacccacgcgctcccaagatgcaataagcaaataaaaagactaataacgctgtaaaaaaggtc

SEQ ID NO: 349743 - DNA, 609 bp, Homo sapiens
ggggacttgttctctaggtccaggatcttcctaatgcatcgcctcagccatgaacaacgcggagttctttaatacccgtgagcagcagcccaggccccttgaagagtgcagactcccacctggcctgggcgtctggctccgcagcagaacacgaagtttgcattccccaaggggcggccagggggcggaccagggaaaggtagtcctctgcattttgccgtgtgctggaatggtgtagagtgacgatgaggtggcggtaaggggttgagcgctcacgcgaacgcctaagtgaccagaacgactggtgtgaagccgtgatctgactctgtggagcctgggactggtttcagcgagagcctctgtactgctctgtagtctctgctaggacatggacgaaaagggacgcagccgggagagcgactgccccaggtgggggctggggggacgtaagggaagaataatgattatctggctgtgtttttgtttaaaaaaaaaaaaaaaactggtgtaaatctccatagacttcctatcctcgctcccttcacccacccacgcgctcccaagatgcaataagcaaataaaaagactaataacgctgtaaaaaaggtc

SEQ ID NO: 349744 - DNA, 371 bp, Homo sapiens
cgctgccttcatctctccatctctgcgctgctgccggctgcgccatccagcacccagactccagcaccggccgaggacccccactccggctgcagggaccctgtcccagcgagaccgcaggcatgtcatccgaaaagtcaggactcccagactcagtccctcacacttctccgccgccctacaatgcccctcagcctccagccgaacccccagccccaccgccacaggcagccccttcctcacaccatcaccaccaccaccactaccatcagtctggcaccgccaccctcccgcgcttaggggcagggggcctggcctcttccgcggccaccgctcagcgcggtccctcctcctctgccacgctgccgagg

SEQ ID NO: 349745 - DNA, 2571 bp, Homo sapiens
ggggacttgttctctaggtccaggatcttcctaatgcatcgcctcagccatgaacaacgcggagttctttaatacccgtgagcagcagcccaggccccttgaagagtgcagactcccacctggcctgggtccgtaggcctcgctccacccgctgtttacttatcccaagtctggaacccacggtggcggggggaagggcgtctggctccgcagcagaacacgaagtttgcattccccaaggggcggccagggggcggaccagggaaagtccgccccaggtcagcgacttacaactcttcattctgaagtgcgtgtagtgcccttgtctccagagacgcagagagtcctcgaggccccttgagctaagtgcagcctggcccagtttctcctgccctactctactcccctccctataagcgacccaccctcaaggggcggagggcgcgtagggatgcgctgactcatgcccgcgtaatttcgaccagtctttcaacctgaacgacccccagaatctggctgtctgagttatctgtgggtggctccctaccgaaacccccaggcgccccacctctccgcctgtgacccctaaccgacaccctagtgcctcagggcttttacttgctagggcttttacttagcatttaaagacgtttctctagagataaggatttctcagcatgtctgagcccctctctctgtttacaaggtcattgcttggtctaaatttgtctcaatcaaaacatttttgcgctcagaatggtgtagagtgacgatgaggtggcggtaaggggttgagcgctcacgcgaacgcctaagtgaccagaacgactggtgtgaagccgtgatctgactctgtggagcctgggactggtttcagcgagagcctctgtactgctctgtagtctctgctaggacatggacgaaaagggacgcagccgggagagcgactgccccagtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttat

SEQ ID NO: 349746 - DNA, 2177 bp, Homo sapiens
atgccacccgacccttacctgcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttataaaaaaaaacaaaaaaaaaaaaaaaaaaaaaaaaaaaaaaaaacaaaaaaaaaaaaaaaaacacaccaacaaaaacaaaaaaacaacaaaaaaaacaaaaacaacaacaaaaaaaggcgggcgcggcgcgcccctatactataatcccctcccaccgccgaggcaggcgcagcaccttcaggccgccaccctcctcactctcttcttatctgactacgacgcggcgcgccctcctctatgtgcgggatcgtctttattattatagacgagcacaacgacgcggcgcgcgatctcacctcatacaaaggccaatagcgagacgcggacagacgaagaacatcctgatgtcggcgcgcagaccccacggcttgtccgacagacggggagccccactactaactgtctgtcgccgctgcgcggcgcgagacgcccgccgtcgcgccgccaacacccactcgtcccggcgtgcgcagtctattgatgcataccgccccgccagctggagccgcgcgtcatagcaataccaaaaaaactagccgctcgacgcggcgccgagaggagagacggcgcgtgagtacacaacgcaccgcgcgtctccgacatgtgtctgtgtccgccgggcgccgcaagttgagagttttgtgctgtcccgcgcgaggcgagcgtgtctcaatacgattcgcggcgacgctgctaagttaagcataggg

SEQ ID NO: 349747 - DNA, 1136 bp, Homo sapiens
ggggacttgttctctaggtccaggatcttcctaatgcatcgcctcagccatgaacaacgcggagttctttaatacccgtgagcagcagcccaggccccttgaagagtgcagactcccacctggcctgggtccgtaggcctcgctccacccgctgtttacttatcccaagtctggaacccacggtggcggggggaagggcgtctggctccgcagcagaacacgaagtttgcattccccaaggggcggccagggggcggaccagggaaagtccgccccaggtcagcgacttacaactcttcattctgaagtgcgtgtagtgcccttgtctccagagacgcagagagtcctcgaggccccttgagctaagtgcagcctggcccagtttctcctgccctactctactcccctccctataagcgacccaccctcaaggggcggagggcgcgtagggatgcgctgactcatgcccgcgtaatttcgaccagtctttcaacctgaacgacccccagaatctggctgtctgagttatctgtgggtggctccctaccgaaacccccaggcgccccacctctccgcctgtgacccctaaccgacaccctagtgcctcagggcttttacttgctagggcttttacttagcatttaaagacgtttctctagagataaggatttctcagcatgtctgagcccctctctctgtttacaaggtcattgcttggtctaaatttgtctcaatcaaaacatttttgcgctcagaatggtgtagagtgacgatgaggtggcggtaaggggttgagcgctcacgcgaacgcctaagtgaccagaacgactggtgtgaagccgtgatctgactctgtggagcctgggactggtttcagcgagagcctctgtactgctctgtagtctctgctaggacatggacgaaaagggacgcagccgggagagcgactgccccaggtgggggctggggggacgtaagggaagaataatgattatctggctgtgtttttgtttaaaaaaaaaaaaaaaactggtgtaaatctccatagacttcctatcctcgctcccttcacccacccacgcgctcccaagatgcaataagcaaataaaaagactaataacgctgtaaaaaaggtc

SEQ ID NO: 349748 - DNA, 286 bp, Homo sapiens
agatggcctagatacagcccctctcttgcccctcaaattagagatggtttctcacccgtctctctctatgtgtctctcccattatctttctccatccctgaccggctgtgtttccccttaccccctcctcaactcatcactgtgtcatctttcctcttatactctcctccactcacctcccccaggactcccagactcagtccctcacacttctccgccgccctacaatgcccctcagcctccagccgaacccccagccccaccgccacaggcagccccttcctca

SEQ ID NO: 349749 - DNA, 2044 bp, Homo sapiens
ggggacttgttctctaggtccaggatcttcctaatgcatcgcctcagccatgaacaacgcggagttctttaatacccgtgagcagcagcccaggccccttgaagagtgcagactcccacctggcctgggcgtctggctccgcagcagaacacgaagtttgcattccccaaggggcggccagggggcggaccagggaaaggtagtcctctgcattttgccgtgtgctggaatggtgtagagtgacgatgaggtggcggtaaggggttgagcgctcacgcgaacgcctaagtgaccagaacgactggtgtgaagccgtgatctgactctgtggagcctgggactggtttcagcgagagcctctgtactgctctgtagtctctgctaggacatggacgaaaagggacgcagccgggagagcgactgccccagtcccacccgcctcgcctggtctagcctccgtgtttccatgacaactccaaaggagcccaaactgggggcttgaatgccgggcacccagactccagcaccggccgaggacccccactccggctgcagggaccctgtcccagcgagaccgcaggcatgtcatccgaaaagtcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttat

SEQ ID NO: 349750 - DNA, 2078 bp, Homo sapiens
cgctgccttcatctctccatctctgcgctgctgccggctgcgccatccagcacccagactccagcaccggccgaggacccccactccggctgcagggaccctgtcccagcgagaccgcaggcatgtcatccgaaaagtcagccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttgatttataaaaaaaaacaaaaaaaaaaaaaaaaaaaaaaaaaaaaaaaaacaaaaaaaaaaaaaaaaacacaccaacaaaaacaaaaaaacaacaaaaaaaacaaaaacaacaacaaaaaaaggcgggcgcggcgcgcccctatactataatcccctcccaccgccgaggcaggcgcagcaccttcaggccgccaccctcctcactctcttcttatctgactacgacgcggcgcgccctcctctatgtgcgggatcgtctttattattatagacgagcacaacgacgcggcgcgcgatctcacctcatacaaaggccaatagcgagacgcggacagacgaagaacatcctgatgtcggcgcgcagaccccacggcttgtccgacagacggggagccccactactaactgtctgtcgccgctgcgcggcgcgagacgcccgccgtcgcgccgccaacacccactcgtcccggcgtgcgcagtctattgatgcataccgccccgccagctggagccgcgcgtcatagcaataccaaaaaaactagccgctcgacgcggcgccgagaggagagacggcgcgtgagtacacaacgcaccgcgcgtctccgacatgtgtctgtgtccgccgggcgccgcaagttgagagttttgtgctgtcccgcgcgaggcgagcgtgtctcaatacgattcgcggcgacgctgctaagttaagcataggg

SEQ ID NO: 349751 - DNA, 1744 bp, Homo sapiens
  misc_feature (32)..(32): n is a, c, g, or t
  misc_feature (35)..(35): n is a, c, g, or t
  misc_feature (39)..(39): n is a, c, g, or t
  misc_feature (46)..(46): n is a, c, g, or t
  misc_feature (70)..(70): n is a, c, g, or t
  misc_feature (73)..(73): n is a, c, g, or t
actacggcgggtaacgtaattatgaacctacnatnatgngggcgancaccttgcgaagcgtttaatcggncgngtgcgcgatactcgttacatacatatacagtatgatcagccaatcgcgactcgaatcgcgaacgaggtgcagcgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349752 - DNA, 1619 bp, Homo sapiens
  misc_feature (32)..(32): n is a, c, g, or t
  misc_feature (35)..(35): n is a, c, g, or t
  misc_feature (39)..(39): n is a, c, g, or t
  misc_feature (46)..(46): n is a, c, g, or t
  misc_feature (70)..(70): n is a, c, g, or t
  misc_feature (73)..(73): n is a, c, g, or t
actacggcgggtaacgtaattatgaacctacnatnatgngggcgancaccttgcgaagcgtttaatcggncgngtgcgcgatactcgttacatacatatacagtatgatcagccaatcgcgactcgaatcgcgaacgaggtgcagcgcgcccagtgatggattcaagcctcgtgaacgaagcggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349753 - DNA, 2423 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtaaggtctgggctcaaccctgaaattcttggtagagctgaacttagtatagaattcccagagcagtaggcattttaacaatgcttacaatgagctagaagacacatgacagttccacaccctgccccagggcacatcctttgagggctgctgccataattggaagtcacagttaggaccttcttcatcctttgtagggatttgatattcaacagcacagctgaaatactagctcagccatagttttcctgccctaaagaagggctgaaacagctactgagtgacagagttggctgacaaaactgttcttttcttaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349754 - DNA, 2502 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatgggtaagaagccttagaacaaagttagaatgaacttgtcagtagggaagaagggaggaagaggaaaagggagaactaaatgtggatttttaagcgagaaaatgggagaacaacatgattaataccaggacaaggactgttattatttttctatgtttgtggaaactccactcctgttcttgcagtagcttcctggctgagtgaaagagggagtctgaacccatcactgtacagctagccatatgcttggcaactgtttgttcctaacatttcaggagtccagtctagatataaagcacacagggaactcatcttatccatggggttttccttgttcgatgactggacagaaggactgtggtctccatctagctctgaactcttttttcccccttctagttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349755 - DNA, 1478 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaagagatgcgacttgctctgttgtccagacttgagtgcagtagctcaatcatagctcactgcagccttgaattccgggctaccacacccagcttgttactgtatttttgaatgtctgaagtgaagaatgaatctaagtggggactgcttggctcggtcattcagttacatccacagcacagagaaactgaggattctttgttgatgaggtgtctggatcgtatctattccagagtaaagtcatgatggctttatgacgttctgaggtgcgttttgcaggaggggacgttgttgagttccaaacaggtgaggtattgcacactagcaaacacatgagaagaaggcggaggaattgggag

SEQ ID NO: 349756 - DNA, 2582 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatgggtaagaagccttagaacaaagttagaatgaacttgtcagtagggaagaagggaggaagaggaaaagggagaactaaatgtggatttttaagcgagaaaatgggagaacaacatgattaataccaggacaaggactgttattatttttctatgtttgtggaaactccactcctgttcttgcagtagcttcctggctgagtgaaagagggagtctgaacccatcactgtacagctagccatatgcttggcaactgtttgttcctaacatttcaggagtccagtctagatataaagcacacagggaactcatcttatccatggggttttccttgttcgatgactggacagaaggactgtggtctccatctagctctgaactcttttttcccccttctagttcaacttttacacaagctcagtgttcgagcagctgatggcccccagaagcttttgaaggtgaggtattgaaacctgttagttgaaggctggttctgggaatgtttctggggctgacttttctctcttttttactttaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349757 - DNA, 1567 bp, Homo sapiens
  misc_feature (34)..(34): n is a, c, g, or t
catgatacgaattgagctggtcccgaaggagacncaggtgaggtattgaaacctgttagttgaaggctggttctgggaatgtttctggggctgacttttctctcttttttactttaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtaaggtctgggctcaaccctgaaattcttggtagagctgaacttagtatagaattcccagagcagtaggcattttaacaatgcttacaatgagctagaagacacatgacagttccacaccctgccccagggcacatcctttgagggctgctgccataattggaagtcacagttaggaccttcttcatcctttgtagggatttgatattcaacagcacagctgaaatactagctcagccatagttttcctgccctaaagaagggctgaaacagctactgagtgacagagttggctgacaaaactgttcttttcttaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349758 - DNA, 1956 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349759 - DNA, 1308 bp, Homo sapiens
gcagcagaaagggggtagttactgatggacaccatcttctctgtatactccacactgacctaagaaaagaacagtaggcattttaacaatgcttacaatgagctagaagacacatgacagttccacaccctgccccagggcacatcctttgagggctgctgccataattggaagtcacagttaggaccttcttcatcctttgtagggatttgatattcaacagcacagctgaaatactagctcagccatagttttcctgccctaaagaagggctgaaacagctactgagtgacagagttggctgacaaaactgttcttttcttaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349760 - DNA, 2106 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349761 - DNA, 1673 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaaaaaaaaaaaaaagaaaaacaaacaaaaacaaaaaaaacataacaaaaaaagaaaaacaaaaaactaaagaacgaaaaaaaaaaaaaaaaaatttaaaaaaaaaaaaataagaaagaataaaaaccctgggggcccgcctggcccaagctaattttagattgggaaagtttttttcatgggcccaaatttcagtttacttggccaatttccccttatgggggggggattaaaaatcaagggcccggggtttaaaaaggggggaccgggg

SEQ ID NO: 349762 - DNA, 1428 bp, Homo sapiens
gtgtctagaggatcccataggaagaatgtgcacatcttccaatatggaagaatgtgcgggaccctggggaagcgcggcagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349763 - DNA, 2613 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccaggtaactccagggacagtgctcacaaccctttgagcctctgtatggaagggttggcagctgagtgctgcctctcttcagccttaaccatgtctcggtttctgctttgctcagagtttgctgatgctgatggatagtcccctgaaccgagctggcttgctacaggtttatatccatacacagaagaatgttctgattgaagtgaatccccagacccgaattcccagaacctttgaccgcttttgtggcctcatgggtaagaagccttagaacaaagttagaatgaacttgtcagtagggaagaagggaggaagaggaaaagggagaactaaatgtggatttttaagcgagaaaatgggagaacaacatgattaataccaggacaaggactgttattatttttctatgtttgtggaaactccactcctgttcttgcagtagcttcctggctgagtgaaagagggagtctgaacccatcactgtacagctagccatatgcttggcaactgtttgttcctaacatttcaggagtccagtctagatataaagcacacagggaactcatcttatccatggggttttccttgttcgatgactggacagaaggactgtggtctccatctagctctgaactcttttttcccccttctagttcaacttttacacaagctcagtgttcgagcagctgatggcccccagaagcttttgaaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349764 - DNA, 2186 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtgaggtattgaaacctgttagttgaaggctggttctgggaatgtttctggggctgacttttctctcttttttactttaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349765 - DNA, 2503 bp, Homo sapiens
aacacagattcgcgcacaccgtaggccacggcgccggcccccagcaacagcttcagggccgtgcccatgccccggggcccggcgggcagccgtcccgccaagtccttcaagttctgggccatgtctgatcttgaggccggcggcactggaggtcagaagggggtgccggcccgcctctaccccgctccggcttaggtactgcacccttcacacgagggttcgggcccgtaaggctggcgaaagaaagggcagcggaagtgcgctccctttgaaaccctcccccttagcccactacggacccgaacttcgcgcacaggaatcgcgcatacggaagtcccgcccctttctggaaggctgccctcccagggagggcagcgcaagacagcaagtcatctccatttcctggcccactttcaaaatggcagccggaaggaaatttgtgattagaagccgcgctgttcttatttaagagcgttagcgcaacttccggtattgttgcaagatggccgcgcccagtgatggattcaagcctcgtgaacgaagcggtggggagcaggcacaggactgggatgctctgccacccaagcggccccgactaggggcaggaaacaagatcggaggccgtaggcttattgtggtgctggaaggggccagtctggagacagtcaaggtagggaagacatatgagctactcaactgtgacaagcacaagtctatattgttgaagaatggacgggaccctggggaagcgcggccagatatcacccaccagagtttgctgatgctgatggatagtcccctgaaccgagctggcttgctacaggtttatatccatacacagaagaatgttctgattgaagtgaatccccagacccgaattcccagaacctttgaccgcttttgtggcctcatggttcaacttttacacaagctcagtgttcgagcagctgatggcccccagaagcttttgaaggtgaggtattgaaacctgttagttgaaggctggttctgggaatgtttctggggctgacttttctctcttttttactttaggtaattaagaatccagtatcagatcactttccagttggatgtatgaaagttggcacttctttttccatcccggttgtcagtgatgtgcgtgagctggtgcccagcagtgatcctattgtttttgtggtaggggcctttgcccatggcaaggtaaggtctgggctcaaccctgaaattcttggtagagctgaacttagtatagaattcccagagcagtaggcattttaacaatgcttacaatgagctagaagacacatgacagttccacaccctgccccagggcacatcctttgagggctgctgccataattggaagtcacagttaggaccttcttcatcctttgtagggatttgatattcaacagcacagctgaaatactagctcagccatagttttcctgccctaaagaagggctgaaacagctactgagtgacagagttggctgacaaaactgttcttttcttaggtcagtgtggagtatacagagaagatggtgtccatcagtaactaccccctttctgctgccctcacctgtgcaaaacttaccacagcctttgaggaagtatggggggtcatttgacagtagtagaacctgttctgaaaccagaaactgttgatgtcacatcctttgaccctggtctgagctgactgctggaagatgatctttctgcactgagactgtggagtttggggaagccaaggctgtacatttgctatttgtttatcctatgaatactgttcttgcaaacctggttgttttggggttcctaaagtatccagtggtgtaaaactgtttgttccccgggacttcagggacagataggaggttacagagtttgcagtttggttccatgctttgaaggcaggctttagctcccagattcccatgtgctaaaggagagaaccctgatgatggagaagaactgtgaaagagagcagtcaggaatgctagtggtgaaaaactgaacaaacagaagtgattttatctaatacagttccaaggtagaaaaagtggagcaggcagggccttgcacccctctccacccccccatggggggggtggtggtagcggcacatacacaatcatagtaaattggcagaagaaaaacacaatagattcctggctagatggggagagataaggcaatgtgcatgggggaatcagaggggagatgtgagcccctctgctcctcccacaagagtttcccctttgggccgggcacggtggctcacgcctgtaatcccagcactttgggaggcggaggcgggtggatcacttgcggtcaggagttcgagaccagcctggccaacgtggtgaaatcccgtttctactgaaaatacaaaaattagctgggcatggtggcgtgcctgtattcccaaagtgctgggattacaggcatcactggcccaggcagagccaattctgtataataaatctgtctctctctg

SEQ ID NO: 349766 - DNA, 3053 bp, Homo sapiens
ccttcaatgtgaagctaatatctcctatagcatagttaatgtttattcaacaaatattcatgcagcggagtcaagaacacaccacgatggcggagaaaggaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349767 - DNA, 2997 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349768 - DNA, 3442 bp, Homo sapiens
  misc_feature (3289)..(3289): n is a, c, g, or t
  misc_feature (3294)..(3294): n is a, c, g, or t
  misc_feature (3300)..(3300): n is a, c, g, or t
  misc_feature (3311)..(3312): n is a, c, g, or t
  misc_feature (3316)..(3316): n is a, c, g, or t
  misc_feature (3327)..(3327): n is a, c, g, or t
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaagtctgatgtgccttgatgtggaaagggagacggggaagatggaaatggacattacaaccagggatgtgttcagtcctgtgctggttctggcctggaatgtaggaatataaggcagctctcactgtggtcacttccaggcaggggatgcctgccgggcttggagggctttctgtaccacatcttcccactgggcatccgatatctcccgagcccaggcaggaacccctggcgcaggcaggcttactccagccattgtccttttcaccagctctacatgttctgggtccatggnaatanagctgnggttgttcaannctgnagctccctccncatctacatcttcattttctaatggtgagtcctccaaaagaaaccccaggggctgggactccatcctggaagacaacaaatacatctcccccccccccggcggggcaagatccac

SEQ ID NO: 349769 - DNA, 3644 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaaaaaaaaaaaaacaaaaaaaaaaaaaacaaaaacaaaaaaaacaaaaaaatccgggggttttttgtgtgcggggggcggagaaaaagagaggcgtaagaagaagaggggcccgagtgggcccaaagcgtgtgtttctcgtggaacccaattttttttgtgtacaccagagggggaaaattcgcgcgcgggtcccccttattatggggaggcagcgctatatatatttcttcgcgcaaaaggccgcgggtgtataacccgcggctcttatatatggttatctttctgcgcacacagccgggaaaaacataaaaaaaaccagaacaggcagagggaacaaaaaaaggaggaggtaaacacaaggagatggagggaaaaaaagaggagcgggggcggaaagagaaaagagcaaaaagccagcaacacggaggaccagagaaagataaacacgaggagaaggaggccagaataaagaaattgaaataaaaacaagcgaaaagagacaaaacatcaaaaatgtacaaaaatatatacatcatcacacctctgtatcattctatacctcattaaacatcctcagacaactaaccaaacacacacaaaggaacagtaaaaaagaaaaacaatgaggcaaactacagaaaagaaaa

SEQ ID NO: 349770 - DNA, 3346 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaaaaaaaaaaaaacaaaaaaaaaaaaaaaagggggggggggtaaaaaatttccctgggggggcccaagtttagggttacccggtttttttgtaaaggggggccctaaaagggaagccgaattaaaaaagagaagggaaaggggacgcggcggttttaaaaacgtcggtgagtgggggacaatggtctacgtggggattgtgtggagcgaactgctatttgctgggggggtggcatattggggaattactcagggaatttgaggatcaggggaactttcacaatttcagtgtttagtggtgaaccagccgcatttgctggcgtgagaaatttgtgacgagatgtttggaata

SEQ ID NO: 349771 - DNA, 3341 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaagtctgatgtgccttgatgtggaaagggagacggggaagatggaaatggacattacaaccagggatgtgttcagtcctgtgctggttctggcctggaatgtaggaatataaggcagctctcactgtggtcacttccaggcaggggatgcctgccgggcttggagggctttctgtaccacatcttcccactgggcatccgatatctcccgagcccagggccttctgaagggccctgatgtcccagttcctcagtctgattggggaagatacgctcagggcccatggtgtctcctcctagaactactgttgccatccgggcaggggccgctcagagcccgggaggcg

SEQ ID NO: 349772 - DNA, 3513 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaagtctgatgtgccttgatgtggaaagggagacggggaagatggaaatggacattacaaccagggatgtgttcagtcctgtgctggttctggcctggaatgtaggaatattttacctgggtcccatgggaatagagctgtggttgttcaacagctgtagctccctcctcatcttcatcttcactctctaatggtgggtctggcaaatgaagccccagggccctggattcgatcctggatgtcagcaactacatctccatcccccactggtgcccagttccacctcctcttgttcaggatcttggttcaggggctggtaggagtagccagctgggcccgaccccgtttcctcctgctcttcctcaggctcctcactgctccaatccccagtgccttctgaagggccctgatgtcccagttcctcagtctgattggggaagatacgctcagggcccatggtgtctcctcctagaactactgttgccatccgggcaggggccgctcagagcccgggaggcg

SEQ ID NO: 349773 - DNA, 3428 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaagtctgatgtgccttgatgtggaaagggagacggggaagatggaaatggacattacaaccagggatgtgttcagtcctgtgctggttctggcctggaatgtaggaatataaggcagctctcactgtggtcacttcctggattcgatcctggatgtcagcaactacatctccatcccccactggtgcccagttccacctcctcttgttcaggatcttggttcaggggctggtaggagtagccagctgggcccgaccccgtttcctcctgctcttcctcaggctcctcactgctccaatccccagtgccttctgaagggccctgatgtcccagttcctcagtctgattggggaagatacgctcagggcccatggtgtctcctcctagaactactgttgccatccgggcaggggccgctcagagcccgggaggcg

SEQ ID NO: 349774 - DNA, 2943 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcaggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349775 - DNA, 2811 bp, Homo sapiens
  misc_feature (2795)..(2795): n is a, c, g, or t
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctacgctggaatgnattggaccgacactga

SEQ ID NO: 349776 - DNA, 3104 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccaggtaccagggcaagggggcagattggccgtggctgcagggagtggggcacttggaggcctgcaagtccttgggaacatcccctcagtggcgtgccttttcccctatagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349777 - DNA, 2943 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccgtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349778 - DNA, 2735 bp, Homo sapiens
ccttcaatgtgaagctaatatctcctatagcatagttaatgtttattcaacaaatattcatgcagcggagtcaagaacacaccacgatggcggagaaaggaagagacgccgagcgggccgagtgcggccgagcaaagccggagccggagcggggccgcaggagacgggccgggtccggacgggccgagatgccctataaactgaaaaaggagaaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349779 - DNA, 3189 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatggtgggcacagggaaaggacacaggggggactggtgaggggctctggagaagcccaggtggagctctaactggccctacccctcagttttcagtgaacctcttccggacgctgccaccttcatcgaatcccacaggggctgagtttgacccagaggaagatgagcccaccctggaagctgcttggccacatctccaggtaccagggcaagggggcagattggccgtggctgcagggagtggggcacttggaggcctgcaagtccttgggaacatcccctcagtggcgtgccttttcccctatagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349780 - DNA, 2024 bp, Homo sapiens
cccttccgggccccaaggcccacctcttactgtcagcatcacttgccagtctgtacctactgggggtgccataagggggaactcaggagggctgtgacctgaccggtaacatggtttcctctctgaaggggaagcaaaacctatatacacctaggaaacagatccaaggcaaagaaacgggtagctggctgagatcacccaaactgtgcccaccagggtgggggagagagcaggtaggggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349781 - DNA, 1926 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtaccctaagttcagagccaggcctggctctgaacttaggcagtcaaagcgaactactatactcaattgatccaataacttgaccaacggaacaagttaccctagggataacagcgcaatcttattctagagtccatatcgactatagcatttacgaccttgatgtatggatcagcacatcccgatggtcaagccgcctagtttcagagctttatttgatccaccgcatgtcatactcaat

SEQ ID NO: 349782 - DNA, 1247 bp, Homo sapiens
  misc_feature (24)..(25): n is a, c, g, or t
  misc_feature (28)..(28): n is a, c, g, or t
  misc_feature (30)..(30): n is a, c, g, or t
  misc_feature (32)..(33): n is a, c, g, or t
  misc_feature (35)..(35): n is a, c, g, or t
  misc_feature (37)..(37): n is a, c, g, or t
  misc_feature (41)..(41): n is a, c, g, or t
ggcagtactatacggtgttaaggnngcnangnngngnggcntgggtgtcgcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349783 - DNA, 823 bp, Homo sapiens
  misc_feature (24)..(25): n is a, c, g, or t
  misc_feature (28)..(28): n is a, c, g, or t
  misc_feature (30)..(30): n is a, c, g, or t
  misc_feature (32)..(33): n is a, c, g, or t
  misc_feature (35)..(35): n is a, c, g, or t
  misc_feature (37)..(37): n is a, c, g, or t
  misc_feature (41)..(41): n is a, c, g, or t
ggcagtactatacggtgttaaggnngcnangnngngnggcntgggtgtcggctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349784 - DNA, 801 bp, Homo sapiens
  misc_feature (648)..(648): n is a, c, g, or t
  misc_feature (653)..(653): n is a, c, g, or t
  misc_feature (659)..(659): n is a, c, g, or t
  misc_feature (670)..(671): n is a, c, g, or t
  misc_feature (675)..(675): n is a, c, g, or t
  misc_feature (686)..(686): n is a, c, g, or t
agcggggtgcaacatggaagggacaccctggaggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaagtctgatgtgccttgatgtggaaagggagacggggaagatggaaatggacattacaaccagggatgtgttcagtcctgtgctggttctggcctggaatgtaggaatataaggcagctctcactgtggtcacttccaggcaggggatgcctgccgggcttggagggctttctgtaccacatcttcccactgggcatccgatatctcccgagcccaggcaggaacccctggcgcaggcaggcttactccagccattgtccttttcaccagctctacatgttctgggtccatggnaatanagctgnggttgttcaannctgnagctccctccncatctacatcttcattttctaatggtgagtcctccaaaagaaaccccaggggctgggactccatcctggaagacaacaaatacatctcccccccccccggcggggcaagatccac

SEQ ID NO: 349785 - DNA, 1308 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatggtgggcacagggaaaggacacaggggggactggtgaggggctctggagaagcccaggtggagctctaactggccctacccctcagttttcagtgaacctcttccggacgctgccaccttcatcgaatcccacaggggctgagtttgacccagaggaagatgagcccaccctggaagctgcttggccacatctccaggtaccagggcaagggggcagattggccgtggctgcagggagtggggcacttggaggcctgcaagtccttgggaacatcccctcagtggcgtgccttttcccctatagctcgtgtatgagttcttcttacgtttccttgagtctcctgatttccagccaaacatagccaagaagtacatcgaccagaagtttgtacttgctgtgagtccccgagttcctgtccttgccctctctttccattccatgcccccttcatctgtgtcccagtggctctttccccttaagctgaatatattgggtttcatccatgtctggtacgaggaggctataaagggtaaaaaacaaaacaaaacaaaaccctactctggccttaagaaactaacaacataatggtaggaaacaaaaaagcaacagagtacctctctcaggtcaatagtgaggcatcactttggaagtctc

SEQ ID NO: 349786 - DNA, 625 bp, Homo sapiens
gtcgacatatggggacatcggtccaagcccaacccaccttagcatgtatcactgggcttggaccgatgtccccatatgtacagaactgaataaagtgggtctctgagaagtctgatgtgccttgatgtggaaagggagacggggaagatggaaatggacattacaaccagggatgtgttcagtcctgtgctggttctggcctggaatgtaggaatattttacctgggtcccatgggaatagagctgtggttgttcaacagctgtagctccctcctcatcttcatcttcactctctaatggtgggtctggcaaatgaagccccagggccctggattcgatcctggatgtcagcaactacatctccatcccccactggtgcccagttccacctcctcttgttcaggatcttggttcaggggctggtaggagtagccagctgggcccgaccccgtttcctcctgctcttcctcaggctcctcactgctccaatccccagtgccttctgaagggccctgatgtcccagttcctcagtctgattggggaagatacgctcagggcccatggtgtctcctcctagaactactgttgccatccgggcaggggccgctcagagcccgggaggcg

SEQ ID NO: 349787 - DNA, 408 bp, Homo sapiens
atcctagcccctgccagaaactgaggtcttgagtgaaatgagcagcacccaccgagtctgcctctccccaccaggtggcagagcgtgctctctattactggaacaatgagtacatcatgagcctgataagtgacaatgctgcccgagtcctccccatcatgttccctgcactctacaggaactccaagagccactggaacaagtaaggcgctggggtggggctgggtggtggggatccagtttgggaaactttgagggtatggaagaactaaagagccaggggtctcacctagtcacccagcaagtggggctgatgtcccctgcatgttgataggaccttgaggggctgactggagcgaaaagatgcctgtgtgcaagatctctgtgataccaaacagcagggcagcg

SEQ ID NO: 349788 - DNA, 249 bp, Homo sapiens
cttccttctactgactcatgccagttcatttccttagtaattattccagaatgaaagaatgatcttttacctgggtcccatgggaatagagctgtggttgttcaacagctgtagctccctcctcatcttcatcttcactctctaatggtgggtctggcaaatgaagccccagggcctgcagagccacagaagaccgtttgggtctaggctttcagggagcccagcttcacctgttcaggaaccatccct

SEQ ID NO: 349789 - DNA, 1417 bp, Homo sapiens
  misc_feature (1)..(1): n is a, c, g, or t
  misc_feature (1264)..(1264): n is a, c, g, or t
  misc_feature (1269)..(1269): n is a, c, g, or t
  misc_feature (1275)..(1275): n is a, c, g, or t
  misc_feature (1286)..(1287): n is a, c, g, or t
  misc_feature (1291)..(1291): n is a, c, g, or t
  misc_feature (1302)..(1302): n is a, c, g, or t
nccttgttctctccctctgccgtccggctcttgttgtcgtctgttgctcttgctcgtcctcggcctggttgcgctgctgcgtgttgtcgctgcgtcgtttgttggtggctgtgctcgtgcggtgttctttttgggtggtgtgtcgccgtgcgtctgctttgctgcttgttgcgtgcgttgcctgctgtgcctcctgcttctgttctcttcgcgtggtctgtcagttattcttctgcgctgcgtcgtcccgttgttggttgtttttcgtcttctactcacctctatgtgtttactacgcattttggtttgttgtgttactaatactcgtcgggggtatcttgtgtgtcgccgtttttatccgccggtttgggtgttgtcgtctgagctgcctctcaatctgtgttggtttgtcctgtggggtacacgttgttgctgggtgtggtgtgttcctatcctgatagtctcgtacctgtaggtgtcgctgcgctgccggtagtttgatttcgctagcaaggtgctattgttgtttgcccttgccctgtcttcctatcgcgcggtgcgcgcgaggccccgcatgccagcgcacgcgcagacctccatgaggatgcacacccaccccctgctgactctcgttcggtgtcgttggtgtggcatgggttgcccctcaatgcgtcgtattcgttttcttgggatggctcgcgccgccgctctcggctctctctttgctggtcttggctgttgctgtggtcttggtgctcttgctctgtagttgtttttgtttgttttggttgttggtgtgttcttttgggtttttttttttggtttttttttttttttttttttttttgttttttttttttggctgtgtacatagggtgctttattctccacagagtgatacatgctaaggtgggttgggcttggaccgatgtccccatatgtacagaactgaataaagtgggtctctgagaagtctgatgtgccttgatgtggaaagggagacggggaagatggaaatggacattacaaccagggatgtgttcagtcctgtgctggttctggcctggaatgtaggaatataaggcagctctcactgtggtcacttccaggcaggggatgcctgccgggcttggagggctttctgtaccacatcttcccactgggcatccgatatctcccgagcccaggcaggaacccctggcgcaggcaggcttactccagccattgtccttttcaccagctctacatgttctgggtccatggnaatanagctgnggttgttcaannctgnagctccctccncatctacatcttcattttctaatggtgagtcctccaaaagaaaccccaggggctgggactccatcctggaagacaacaaatacatctcccccccccccggcggggcaagatccac

SEQ ID NO: 349790 - DNA, 2901 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349791 - DNA, 3365 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaaaaaaaaaaaaacaaaaaaaaaaaaaacaaaaacaaaaaaaacaaaaaaaaaaccccgggagcgactctattatagcgcggggcgcgcgaggaaaaacaggttataaaaaagcgcgaccagtgggcaccaaaggttttctcccgaaccccaatttcttttcgtgcgacacccaaggggggagaaaatcatccgcgcgggagccccccccataaatgaggagaggcgccgcggtataaaaattctcacggaaaaacccgcccaggtgtaccccccgcggtttaaatagcgtctccccaagaacaaaaacccccgcgaataattccacacccccacagaacaagaacgcgcgaaaatcagtatactccacg

SEQ ID NO: 349792 - DNA, 3132 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggtgaggccaggagcccaggcttaggagcaaaaccttctgctactgaggtggggtgggagcagggaggtggggggactgtacagaatgctggagggacatcaggggttgtcaagagagccatttttcttccctcaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349793 - DNA, 2641 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggtgtttattcatccctccgtcgacgcggccgcgaatttagtagtagtag

SEQ ID NO: 349794 - DNA, 3082 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatggtgggcacagggaaaggacacaggggggactggtgaggggctctggagaagcccaggtggagctctaactggccctacccctcagttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349795 - DNA, 1893 bp, Homo sapiens
taattctacattcaccgaggtgcaagctctctgtagttgtctaccaggccgcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctccccaaaaggtgttcatgcctccctgtggctagtacaggctgagcactaagatgcttagtgctcagacaacctggggatgcctgtcccctacctgctcctcacccacagctacctgaggctgctctgagaagtacacacaggaatacatacgctcctctattcttcccttcatcctcatttgaacgccaggtatctcccctcctctctctcccctgcagaggcatgtagggaacagcaggagattattctcaccaaagttatgtcaagccccattggtcccagagtagctgaagggaagccaacccccctgcagcacaaataggccccccagtcccagccgtgtgctggcagatagggttgtattatttcttcttaccccatgcctgaccaagggaggtcaaaaggagaaaagtataggctgtggacaataactgatgaatatagggcccagatggaccaagtggggccggggagggatgaataaacaccctaccccgtgccctgtctttggtgagcagcagccctggggtcacagacatggaagggaccaccctggggctgactgcttttctgtgctgttggttcccaaaactagaaagaaggaagcagggagcggtgccccaagcatggctcctgccaacacctatttatttccttgtttgtgctatgctgggcaggccttctcttgtcccttataggtaccttggaggggccaggggctgaggaaggccggacccaggttccaggggcgcaggcagtgcggcttttggctgtgtacatagggtgctttattctccacagagtgatacatgctaaggtgggttgggcttggaccgatgtccccatatgtacagaactgaataaagtgggtctctgagaa

SEQ ID NO: 349796 - DNA, 2210 bp, Homo sapiens
  misc_feature (2049)..(2050): n is a, c, g, or t
  misc_feature (2052)..(2052): n is a, c, g, or t
  misc_feature (2054)..(2054): n is a, c, g, or t
  misc_feature (2058)..(2058): n is a, c, g, or t
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccagctcgtgtatgagttcttcttacgtttccttgagtctcctgatttccagccaaacatagccaagaagtacatcgaccagaagtttgtacttgctctcctagacctatttgacagtgaggatcctcgagagcgggacttcctcaagaccattttgcatcgcatctatggcaagtttttggggctccgggcttatatccgtaggcagatcaaccacatcttctacaggttcatctacgagacggagcatcacaacgggattgctgagctcctggagatcctgggcagcatcatcaatggctttgccctgccccttaaagaagagcacaagatgttcctcatccgtgtcctacttccccttcacaaggtcaagtccctgagtgtctaccaccctcagctggcatactgtgtggtacaattcctggagaaggagagcagtctgactgagccggtaattgtgggacttctcaagttttggcccaagacccacagccccaaggaggtgatgttcttgaatgagctggaggagattctggacgtcattgaaccttctgagttcagcaaagtgatggaacccctcttccgccagctggccaagtgtgtctctagcccccatttccaggtggcagagcgtgctctctattactggaacaatgagtacatcatgagcctgataagtgacaatgctgcccgagtcctccccatcatgttccctgcactctacaggaactccaagagccactggaacaagacaatccatggactgatctataatgccctgaagttgtttatggaaatgaatcagaagctgtttgatgactgcacacaacaatacaaggcagagaagcagaagggccggttccgaatgaaggaaagggaagagatgtggcaaaaaatcgaggagctggcccggcttaatccccagtatcccatgttccgagcccctccaccactgccccctgtgtactcgatggagacagagacccccacagctgaggacatccagcttctgaagaggactgtggagactgaggctgttcagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgccttnntntnagcntacttaaaggggaagggcggaatgtgggagaacttggaaggaagggaaaaacccagaagaaatgggtcacactattacataccacaaaaaaggtgttcatgacatacatgtagaatagaaaaagatgagcactaagaatgttaagagataaa

SEQ ID NO: 349797 - DNA, 1223 bp, Homo sapiens
gcgcaggcaccgctcgacccgggcgcagcgcgcaggcggtggcgaagagacgccgagcgggccgagtgcggccgagcaaagccggagccggagcggggccgcaggagacgggccgggtccggacgggccgagatgccctataaactgaaaaaggagaaggagccccccaaggttgccaaatgcacagccaagcctagcagctcgggcaaggatggtggaggcgagaacactgaggaggcccagccgcagccccagccccagccccagccccaagcccagtctcagccaccgtcatccaacaagcgtcccagcaatagcacgccgccccccacgcagctcagcaaaatcaagtactcaggggggccccagattgtcaagaaggagcgacggcaaagctcctcccgcttcaacctcagcaagaatcgggagctgcagaagcttcctgccctgaaagattcgccaacccaggagcgggaggagctgtttatccagaagctacgccagtgctgtgtcctctttgacttcgtgtcagacccactcagtgacctcaaattcaaggaggtgaagcgggcaggactcaacgagatggtggagtacatcacccatagccgtgatgttgtcactgaggccatttaccctgaggctgtcaccatgttttcagtgaacctcttccggacgctgccaccttcatcgaatcccacaggggctgagtttgacccagaggaagatgagcccaccctggaagctgcttggccacatctccaggtaccagggcaagggggcagattggccgtggctgcagggagtggggcacttggaggcctgcaagtccttgggaacatcccctcagtggcgtgccttttcccctatagctcgtgtatgagttcttcttacgtttccttgagtctcctgatttccagccaaacatagccaagaagtacatcgaccagaagtttgtacttgctgtgagtccccgagttcctgtccttgccctctctttccattccatgcccccttcatctgtgtcccagtggctctttccccttaagctgaatatattgggtttcatccatgtctggtacgaggaggctataaagggtaaaaaacaaaacaaaacaaaaccctactctggccttaagaaactaacaacataatggtaggaaacaaaaaagcaacagagtacctctctcaggtcaatagtgaggcatcactttggaagtctc

SEQ ID NO: 349798 - DNA, 389 bp, Homo sapiens
ataaggggacggaacaatagaattcactgggaattggtcaccattcctcaccttgtccctattcacacacagatgctaaaagacatcaagaaggagaaagtgctgctgcggaggaagtcggagctgccccaggacgtgtacaccatcaaggcactggaggcgcacaagcgggcggaagagttcctaactgccagccaggaggctctctgacccctcacgttcctaccacagggccacagcccacacagccctgggacactgccctggccctccatactctgctccctactggctgtcttgggggaaggcagcgcctctctagctactcaagggagggggatgtgggcacttgaagcagggacacccacagaatggtccctcttctcccc

SEQ ID NO: 349799 - DNA, 8035 bp, Homo sapiens
gcggaggcaagctcagagcgcacggacagagcggtagcgcgcgcccgcgcgcgttcttagtactctccccggtgacgtgcctgaccgaggccgcgccagggcgctgttgctgccaatacagctgtcatggcgtccaaggcgctggctgcggagaagtggccgcggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcagctacaaccaactagtggagaagatcatctcttgtaaacagtcagacaatagtgagctggttagtgaaggctttgtagctgagcagtttctaaataacacagccactcaactgacataccatggattatgtgaactaacttcaacggttcaggaaggagaactttgtgtgttctttcggaataatcattttagcaccatgaccaaatacaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagcagggccagccagcacaagcctctccatcaagtggaagacaatctgggaatagtgaacgtaaacggaaggaaccacgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgtcattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagatttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaaaaaaattagagctattgtgtctttattttcttaaattttgcccaaggtaacgttatatatcccaccacttcattgctggtttgggtacataggattttgaaagtggtatattaaagtctttccttccaagtattttgtaatacttgaaaattcttagatgtatactgctaacaaaagttagaacttaaacatttttgtttttatcatttatagcctagattagggacatatttgcatcaaccaaatcatcattagatttgaaaataggcagatgaatgaacaaatatggtcattgcactttccttttactttcagagtctaagtatattccttaaggttagtaaccagtctttattaaaaatataaaatttttcttcatgtctaatcccattgcatccacaatgctgtgatttatagtacatgatcaacacttaaaagtactttacatatgtgtgtttctgaagcaagttttcatgacctctgttagattctcaaaagaattcagaacttcaatttaagaatcaccattttaagaatacatgtgtacatatacacattaagcagtataaagcagctaaaattggcattggttttacactggtgcagtgtgcttaggtaaagtaacttcttccatgtttcaaggtcaggttcagagttgaatgaagtgtagatttaaatttaggattaggctttggaatatatcttgtttttattgtctcacatttctgatattgactacttatcccatattctgtttcaaattctttatcatatttcaagttctttctcatacttcttgatcttggcttaactaagcaagttagtatcagagactagttgactgaacccaagattaaacattttgcacttgcacaaaaccttcttagcattttgctttcaatgaatcagaaagtcaattcactaagagacagatcatgagaggaaagagaactagaggccaataaataaaataattgttcatatattaatgttcacatgtgaactacatatctaaaatcttggagaaaaatcaaggcaagaatttccagaactgtcctcaaatagctcatttatttaagttttgttaaaaagcaaaagcgaattgattacatttgattaacttttcctattccatgcacaagttaccttaaaacatgataaaaaccttatgggcattacctatcacacagtacttatgcataaacttataatagtaaaattactaatgtttgataaaataagatggaggcattacaaatagtctacagtttgtattttaaggaattggacatgaagaattctagatcattttgtgtctataaacccgactttctatcttgccttgggcaaactttctgtgcctcaatgtactctttaaatatgtgaaggatgctctttttgattaagtgttttgcactcctgaataaagggcatagtataagcacaaagtatgacttaatttatcacaaatattacacatcctatgttcttgaatgtgcacacttttttctcaataacaaaatatatcttaagtcagtttttttaatgctgtcaaaatttgtagaattttctttgagtatggcatgatctcttcccaaatgcattttacagttttttgtgtgttctatagactatagagtcaaaatcaagagtattttgagaggatcagaagcatttaaaaatctatttttttctagtatctttcacagatctaaatatttagattctctttgcctttttctccatggaatacggtggtatcaaattactaatacagtatataaacttcgtttgcattggtggaattcatttagatctctcaagtaatattattttagggctatataaattgtgtttttagtgtaaaatgttatttgataatgtgaagttaaatcccttttagaaagtgactgaaaatggtaaaggaactcatcagaatcttagcgttcttaagttctctgataatttagtatattttattaatgatgtccaacacctctaagattgttgagaaaacatgaagaattgaggttactcttctcaggtgacactttaaatattaaaatcagaggcttcctgaacaaaacaaattgcaaaatagcgataatggcatgggagaggccagatgcaggactctggtaaatttaacttactttgaatatctatctaaattttagttcatgcatgttcttacttaatcctggtgtttttgctcttagatgttagagtttaataaattgtgatacgcatatatttttttacatgaaggattctactttctaattttacttttctgatctcaagaaaattaaacttgaaaaacggggtaaaattcttcaactattgcctcaagttcagttttgtcctattgtcctgagaaaggagatttagacttgtctgcctaacacaggtattttttagggcatcgtactatcccagagaaagtgttgagataccatggcagaaatataaaacctaagctttgaaccccagtagacttcttcttctgccattaagtctctctttatctgatattctaaggatttcttcaaactacttaataatttgtcaccattaactttaatatccagttttaatctgcactgtaatatcctgctttgagaagaaagaatgcctcataaattagagaagtacaaaacaaaatgttttggaaggtgatcctggctcctttggctctcataattgttttatagctgaaaataaaaagtcaggaaactggcccggtgcggtggctcatgcctgtaatcccagcactttgggaggctgaggtgggtggatcacctgaagtcaggagttcgagaccagcctggccaacatggtgaaaccctgtctctactaaaaatacaaaaaaaattagctgggtgtggtggcacatgcctgtaatcccagccactggggaggttgaggcgcaagaatcgcttgaacccggaaggcagaggttgcagtgagccaagattgccccactgcactccagcctgggcgactgagcgagactcttatatctcaaaaa

SEQ ID NO: 349800 - DNA, 4534 bp, Homo sapiens
atcagaccaccgagccaactatctctcaagctagaccatggccatcccgcttatgagcgggcgcagtgattataggctttcgcgctaagattagaactgccctagcccacttcttaccgaggaaggcacacctacaccccttatccccatactagttataattcagacgcaacttggcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaaaaaaattagagctattgtgtctttattttcttaaattttgcccaaggtaacgttatatatcccaccacttcattgctggtttgggtacataggattttgaaagtggtatattaaagtctttccttccaagtattttgtaatacttgaaaattcttagatgtatactgctaacaaaagttagaacttaaacatttttgtttttatcatttatagcctagattagggacatatttgcatcaaccaaatcatcattagatttgaaaataggcagatgaatgaacaaatatggtcattgcactttccttttactttcagagtctaagtatattccttaaggttagtaaccagtctttattaaaaatataaaatttttcttcatgtctaatcccattgcatccacaatgctgtgatttatagtacatgatcaacacttaaaagtactttacatatgtgtgtttctgaagcaagttttcatgacctctgttagattctcaaaagaattcagaacttcaatttaagaatcaccattttaagaatacatgtgtacatatacacattaagcagtataaagcagctaaaattggcattggttttacactggtgcagtgtgcttaggtaaagtaacttcttccatgtttcaaggtcaggttcagagttgaatgaagtgtagatttaaatttaggattaggctttggaatatatcttgtttttattgtctcacatttctgatattgactacttatcccatattctgtttcaaattctttatcatatttcaagttctttctcatacttcttgatcttggcttaactaagcaagttagtatcagagactagttgactgaacccaagattaaacattttgcacttgcacaaaaccttcttagcattttgctttcaatgaatcagaaagtcaattcactaagagacagatcatgagaggaaagagaactagaggccaataaataaaataattgttcatatattaatgttcacatgtgaactacatatctaaaatcttggagaaaaatcaaggcaagaatttccagaactgtcctcaaatagctcatttatttaagttttgttaaaaagcaaaagcgaattgattacatttgattaacttttcctattccatgcacaagttaccttaaaacatgataaaaaccttatgggcattacctatcacacagtacttatgcataaacttataatagtaaaattactaatgtttgataaaataagatggaggcattacaaatagtctacagtttgtattttaaggaattggacatgaagaattctagatcattttgtgtctataaacccgactttctatcttgccttgggcaaactttctgtgcctcaatgtactctttaaatatgtgaaggatgctctttttgattaagtgttttgcactcctgaataaagggcatagtataagcacaaagtatgacttaatttatcacaaatattacacatcctatgttcttgaatgtgcacacttttttctcaataacaaaatatatcttaagtcagtttttttaatgctgtcaaaatttgtagaattttctttgagtatggcatgatctcttcccaaatgcattttacagttttttgtgtgttctatagactatagagtcaaaatcaagagtattttgagaggatcagaagcatttaaaaatctatttttttctagtatctttcacagatctaaatatttagattctctttgcctttttctccatggaatacggtggtatcaaattactaatacagtatataaacttcgtttgcattggtggaattcatttagatctctcaagtaatattattttagggctatataaattgtgtttttagtgtaaaatgttatttgataatgtgaagttaaatcccttttagaaagtgactgaaaatggtaaaggaactcatcagaatcttagcgttcttaagttctctgataatttagtatattttattaatgatgtccaacacctctaagattgttgagaaaacatgaagaattgaggttactcttctcaggtgacactttaaatattaaaatcagaggcttcctgaacaaaacaaattgcaaaatagcgataatggcatgggagaggccagatgcaggactctggtaaatttaacttactttgaatatctatctaaattttagttcatgcatgttcttacttaatcctggtgtttttgctcttagatgttagagtttaataaattgtgatacgcatatatttttttacatgaaggattctactttctaattttacttttctgatctcaagaaaattaaacttgaaaaacggggtaaaattcttcaactattgcctcaagttcagttttgtcctattgtcctgagaaaggagatttagacttgtctgcctaacacaggtattttttagggcatcgtactatcccagagaaagtgttgagataccatggcagaaatataaaacctaagctttgaaccccagtagacttcttcttctgccattaagtctctctttatctgatattctaaggatttcttcaaactacttaataatttgtcaccattaactttaatatccagttttaatctgcactgtaatatcctgctttgagaagaaagaatgcctcataaattagagaagtacaaaacaaaatgttttggaaggtgatcctggctcctttggctctcataattgttttatagctgaaaataaaaagtcaggaaactggcccggtgcggtggctcatgcctgtaatcccagcactttgggaggctgaggtgggtggatcacctgaagtcaggagttcgagaccagcctggccaacatggtgaaaccctgtctctactaaaaatacaaaaaaaattagctgggtgtggtggcacatgcctgtaatcccagccactggggaggttgaggcgcaagaatcgcttgaacccggaaggcagaggttgcagtgagccaagattgccccactgcactccagcctgggcgactgagcgagactcttatatctcaaaaa

SEQ ID NO: 349801 - DNA, 4218 bp, Homo sapiens
gtgactgtaatgtatttttcaggaatttgtatggtatttttctattttgtgaaatgagattataaacccccccaaaggtgtttataagtcatacattagctgaacatgccaagagctcttatttcttgttatagtgtagtgtgccaattataaactatattcaaagccgagtggatttgaggaagtaaaatatctacttggtctatttattgtgttgtacagatctaaacagtaggaatgtttaatatattctgaagatacagattgtaaaactttccttaaatattatattactagttttgatcaatttaacagtcctttttcttttgttacttcttattaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactccgtctcaaaaaaaaaaaaaaaaaaaaaaaattagagctattgtgtctttattttcttaaattttgcccaaggtaacgttatatatcccaccacttcattgctggtttgggtacataggattttgaaagtggtatattaaagtctttccttccaagtattttgtaatacttgaaaattcttagatgtatactgctaacaaaagttagaacttaaacatttttgtttttatcatttatagcctagattagggacatatttgcatcaaccaaatcatcattagatttgaaaataggcagatgaatgaacaaatatggtcattgcactttccttttactttcagagtctaagtatattccttaaggttagtaaccagtctttattaaaaatataaaatttttcttcatgtctaatcccattgcatccacaatgctgtgatttatagtacatgatcaacacttaaaagtactttacatatgtgtgtttctgaagcaagttttcatgacctctgttagattctcaaaagaattcagaacttcaatttaagaatcaccattttaagaatacatgtgtacatatacacattaagcagtataaagcagctaaaattggcattggttttacactggtgcagtgtgcttaggtaaagtaacttcttccatgtttcaaggtcaggttcagagttgaatgaagtgtagatttaaatttaggattaggctttggaatatatcttgtttttattgtctcacatttctgatattgactacttatcccatattctgtttcaaattctttatcatatttcaagttctttctcatacttcttgatcttggcttaactaagcaagttagtatcagagactagttgactgaacccaagattaaacattttgcacttgcacaaaaccttcttagcattttgctttcaatgaatcagaaagtcaattcactaagagacagatcatgagaggaaagagaactagaggccaataaataaaataattgttcatatattaatgttcacatgtgaactacatatctaaaatcttggagaaaaatcaaggcaagaatttccagaactgtcctcaaatagctcatttatttaagttttgttaaaaagcaaaagcgaattgattacatttgattaacttttcctattccatgcacaagttaccttaaaacatgataaaaaccttatgggcattacctatcacacagtacttatgcataaacttataatagtaaaattactaatgtttgataaaataagatggaggcattacaaatagtctacagtttgtattttaaggaattggacatgaagaattctagatcattttgtgtctataaacccgactttctatcttgccttgggcaaactttctgtgcctcaatgtactctttaaatatgtgaaggatgctctttttgattaagtgttttgcactcctgaataaagggcatagtataagcacaaagtatgacttaatttatcacaaatattacacatcctatgttcttgaatgtgcacacttttttctcaataacaaaatatatcttaagtcagtttttttaatgctgtcaaaatttgtagaattttctttgagtatggcatgatctcttcccaaatgcattttacagttttttgtgtgttctatagactatagagtcaaaatcaagagtattttgagaggatcagaagcatttaaaaatctatttttttctagtatctttcacagatctaaatatttagattctctttgcctttttctccatggaatacggtggtatcaaattactaatacagtatataaacttcgtttgcattggtggaattcatttagatctctcaagtaatattattttagggctatataaattgtgtttttagtgtaaaatgttatttgataatgtgaagttaaatcccttttagaaagtgactgaaaatggtaaaggaactcatcagaatcttagcgttcttaagttctctgataatttagtatattttattaatgatgtccaacacctctaagattgttgagaaaacatgaagaattgaggttactcttctcaggtgacactttaaatattaaaatcagaggcttcctgaacaaaacaaattgcaaaatagcgataatggcatgggagaggccagatgcaggactctggtaaatttaacttactttgaatatctatctaaattttagttcatgcatgttcttacttaatcctggtgtttttgctcttagatgttagagtttaataaattgtgatacgcatatatttttttacatgaaggattctactttctaattttacttttctgatctcaagaaaattaaacttgaaaaacggggtaaaattcttcaactattgcctcaagttcagttttgtcctattgtcctgagaaaggagatttagacttgtctgcctaacacaggtattttttagggcatcgtactatcccagagaaagtgttgagataccatggcagaaatataaaacctaagctttgaaccccagtagacttcttcttctgccattaagtctctctttatctgatattctaaggatttcttcaaactacttaataatttgtcaccattaactttaatatccagttttaatctgcactgtaatatcctgctttgagaagaaagaatgcctcataaattagagaagtacaaaacaaaatgttttggaaggtgatcctggctcctttggctctcataattgttttatagctgaaaataaaaagtcaggaaactggcccggtgcggtggctcatgcctgtaatcccagcactttgggaggctgaggtgggtggatcacctgaagtcaggagttcgagaccagcctggccaacatggtgaaaccctgtctctactaaaaatacaaaaaaaattagctgggtgtggtggcacatgcctgtaatcccagccactggggaggttgaggcgcaagaatcgcttgaacccggaaggcagaggttgcagtgagccaagattgccccactgcactccagcctgggcgactgagcgagactcttatatctcaaaaa

SEQ ID NO: 349802 - DNA, 546 bp, Homo sapiens
gaaaaagaataactttttgattttgaaattattcttctatctaatgttatgcattggttctataggctttgtagctgagcagtttctaaataacacagccactcaactgacataccatggattatgtgaactaacttcaacggttcaggaaggagaactttgtgtgttctttcggaataatcattttagcaccatgaccaaatacaaggtatgatatagaaatagctatttaatcgtgattctaaatcaaaggagcttgatttagagttgtcttttgatctgcttataaataaaagattttagcgtaatatttcttaaccatcaaattatgaaggtaattattaaatacagtacttcttaaggatgggatggattaacaattgaagcattacctcaaatcactttttgttttttaattctcaacttctttttcacagatctttgcagtaagaagtattttattattttctttctgagagaaaaaaaagataaaccctagagatagaactaggatgacttctttttttttttttttgaaatggaatt

SEQ ID NO: 349803 - DNA, 4980 bp, Homo sapiens
gcggaggcaagctcagagcgcacggacagagcggtagcgcgcgcccgcgcgcgttcttagtactctccccggtgacgtgcctgaccgaggccgcgccagggcgctgttgctgccaatacagctgtcatggcgtccaaggcgctggctgcggagaagtggccgcggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcagctacaaccaactagtggagaagatcatctcttgtaaacagtcagacaatagtgagctggttagtgaaggctttgtagctgagcagtttctaaataacacagccactcaactgacataccatggattatgtgaactaacttcaacggttcaggaaggagaactttgtgtgttctttcggaataatcattttagcaccatgaccaaatacaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagcagggccagccagcacaagcctctccatcaagtggaagacaatctgggaatagtgaacgtaaacggaaggaaccacgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgtcattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagatttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactcc

SEQ ID NO: 349804 - DNA, 4635 bp, Homo sapiens
gcggaggcaagctcagagcgcacggacagagcggtagcgcgcgcccgcgcgcgttcttagtactctccccggtgacgtgcctgaccgaggccgcgccagggcgctgttgctgccaatacagctgtcatggcgtccaaggcgctggctgcggagaagtggccgcggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcagctacaaccaactagtggagaagatcatctcttgtaaacagtcagacaatagtgagctggttagtgaaggctttgtagctgagcagtttctaaataacacagccactcaactgacataccatggattatgtgaactaacttcaacggttcaggaaggagaactttgtgtgttctttcggaataatcattttagcaccatgaccaaatacaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagcagggccagccagcacaagcctctccatcaagtggaagacaatctgggaatagtgaacgtaaacggaaggaaccacgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgtcattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagatttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcagagatactggtttcctgcccttgaagggtataaagaatttagatcatgcctgtaatcccagtactttgggaggccgaggcaggtggatcacctgagatcaggagttcgagaccagcctggccaacatggcaaaaccctgtctctactaaaaatacaataattagccaggcatggtggcgggcacctgtcatcccagctacttgggaggctgaggcaggagaatcgcttgaacccaggaggcagtgattgcagtgagctgagatagcaccactgcatgcaagcctgggcaatagagcgagactcc

SEQ ID NO: 349805 - DNA, 4677 bp, Homo sapiens
gcggaggcaagctcagagcgcacggacagagcggtagcgcgcgcccgcgcgcgttcttagtactctccccggtgacgtgcctgaccgaggccgcgccagggcgctgttgctgccaatacagctgtcatggcgtccaaggcgctggctgcggagaagtggccgcggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcagctacaaccaactagtggagaagatcatctcttgtaaacagtcagacaatagtgagctggttagtgaaggctttgtagctgagcagtttctaaataacacagccactcaactgacataccatggattatgtgaactaacttcaacggttcaggaaggagaactttgtgtgttctttcggaataatcattttagcaccatgaccaaatacaagggtcaactgtatttgttggtaacggaccaggggtttcttactgaagagaaagttgtttgggaaagcctacacaacgtagatggtgatggaaatttctgtgactcagaatttcatcttcgacctccttcagatcctgaaactgtatacaaaggacaacaagatcagatagatcaggattatcttatggcattatctctacaacaagaacagcagagccaagagatcaattgggaacaaatcccggaaggaatcagtgatttggaactagcaaagaaactccaagaggaagaggacagacgggcttctcaatactatcaggaacaggaacaagcagcagctgctgctgctgctgcttctacacaggctcagcagggccagccagcacaagcctctccatcaagtggaagacaatctgggaatagtgaacgtaaacggaaggaaccacgagaaaaagataaagaaaaagaaaaggaaaaaaatagctgtgttattttgtaacaagtgttggcttctgttggaaccacctatatgtcttgagaaacaaaaccacaggaggaaaggaagaaaaaccgatcaataccgtctgtgcctgatttcctaatggattttgttcgttttttcaggggaacggttgttacttagttacaatcagactttttcaagtcacacaatacactctttatgagctggagtttcatgttacaagttggaaatgctgtgtgttgtcattcatgaaaaatactgcacttgtagccagattagcaaatcacagcaaattttgtgtcatagtgacattcataactcatatcagttagtaagctattatatcttctgttctaacaatgaatggaggtaattgatttagtctgattccttcctgaaatctaaatattagcacaatagtttctgaaattttacaatgttaaattatgatctaattcatgagaaaccacgggtttaacatagggattcaaaaaaacaaaaacaaaagaataggaataaataacccttaattgtatattggactagttcagcccttaaacagctttacctttatttaggaatgtacattttaggtattatcttgatcatggagcttagatttaatttagatagcaaaaataaagatttgtatttcttttccaatagcaaaaagttacataacactaatacttataacctatcaatatcagatattaatgactttgtagtgttgtaaaattttgaggaattttggagtctttatcataggtaacctggaccacagttactatttattgacaatgtgattgagtgtatggaggaaagcacagtggatgctaggctttgtaaatatggggatgtagaaaagcagatagttcagtgtctacctttttctagaactaccttgaaccttaaattttaagtcatgttcattgctagaaaattaaatgtacttattaaaaccaatgaaaaagcacatttctgaaatgaagttagagataatctctgtgtcttataaaaagacattaataaaaatctgaaagggccgggcgcagtggctcacgcctgtaatcccaacattttgggaggccaaggtgggcggatcatctgaggccaggagttcgagaccagcctggccagcatggtgaaaccctgtctctactaaaaatacaaaaaatcagcctggcatggtggtgcgtgcctgtagtcccagctactcagggctgaggcaggagaattgcttgaacccggcaggcagaggttgcagtgagccgagatcgccctgctgcactccagcctgggtgacagagggagactccgtctcaaaaaaaaaaaagtctgagagtagctaagaatttatgtaaaagcaatcagagtttttaatttatgggaaccaaataaaactataacctcatagtgtttataagaactcagaaataatatttatttaactttattatgaggccacacatattttcctgtgtttctatatatagtttggaaaactatccttaatagtctgttttatatgccttatatttaaaagtttgttttagttattttgaaagactattgctgctgcaaatagttgtgtgctttacattctaagcttcagtacatttatttaagagcatcataatctgacctgagcatccacttggagagtgttttttttgtgtgtggtctggggtgacaaaagaccacaaaaatgtgtggtctggattttttcaactatgtcattaactttatgatccaagaccagttataggatgaatctgtatgtaaaaatagagtcttatttatggaaggaattattctaagggaaaaatccagggtcaagctgtatcttttatgtcctttatattgcatgtctatttctgttacacaatttgttatttcttcaaatttcctatggtagcatgataaatcatcaaagaacctgtttgggatataaaactctgatagaaaatatttaatgagtatcttgattataacctagaatatgtatacgttagtaaaataaccagatatactacagaactctctattggctcaaacaggttgacctcaatccaagtttactcttgatatcactctgttggctgaaggaggtaactcaaacctcagggtttgtttttcccgggacagatagtagtgatagtgcattatatttgaataagaaaaacaaaccagtataccttgagaaattttaaaaagcatagttgaggcatattttttcataattatatacttatctgtttattgcccatggaaaatatatgtgtagaagtatttcttctgttatttgttactatcttcttaatttgttccaaagaaaatgctgccatactgcattccctctggaaggaaacaaaacaaaacaaaactcactcaaaaccagcagtgctgctatcagataagtagatgtcaatgtatacttacaaggaaaaactaaaaaatgtaatgtgttaattcagcctttttctatgtaatatttccaagtcagactttcttacattcctggaatttactttgatataccaagaataataatgataaaatgtttgctttgattactgtggggggaaagatgaaatgttcaattgtattaaaacaaacaagcttttcag

SEQ ID NO: 349806 - DNA, 1388 bp, Homo sapiens
gcggaggcaagctcagagcgcacggacagagcggtagcgcgcgcccgcgcgcgttcttagtactctccccggtgacgtgcctgaccgaggccgcgccagggcgctgttgctgccaatacagctgtcatggcgtccaaggcgctggctgcggagaagtggccgcggtctccatagagctgggggcgggcggcccggtatggagagcagccccgagagcctgcagccgctagaacacggggtggcggccgggccagcgtcagggacaggttcttcgcaggaagggctacaggagaccaggctcgccgctggtgatggtcctggggtatgggcggcggagaccagcggcgggaatgggctgggggcggcggccgccaggaggagcctcccggactcggcttctcccgcgggctctcctgaggttcccggaccctgcagctcctccgcgggtttggacttgaaggacagtggtttggagagtcctgctgccgccgaggcgcctctgagagggcagtacaaggtgaccgcctccccggagacagccgtggccggagtgggtcatgagttgggtaccgccggagacgcgggagcccgcccggatctcgccggcacctgccaagcagaactgaccgccgccggctccgaagagcccagcagcgccggcggcctcagcagcagttgcagcgacccgagccctcctggggaatctccgagcctggactctctggagtcgttctctaacctgcattcttttcccagtagctgcgagttcaatagtgaggagggagcggagaacagggtccctgaggaggaggagggcgcggcggtgttgcccggggctgttcctctgtgcaaggaggaggagggggaggagaccgctcaggtgctggcggcctccaaggaacgcttcccgggacaatctgtgtatcacatcaagtggatccagtggaaggaagagaacacacccatcatcacccagaatgagaacggaccctgccccttgctggccatcctcaatgttttgctcctggcctggaaggtgaaacttccaccgatgatggaaatcataactgctgagcagctgatggaatatttaggagattacatgcttgatgcaaagccaaaagaaatttcagaaattcaacgtttaaattatgaacagaatatgagtgatgccatggcaattttgcacaaactacagacaggcctggatgtaaatgtaagattcactggtgttcgagtgtttgaatatacaccagaatgcatagtatttgatcttcttgatattcctttgtaccatgggtggttagtagaccctcagattgatgacattgtaaaagctgttggtaactgcacctgggcgactgagcgagactcttatatctcaaaaa

SEQ ID NO: 349807 - DNA, 204 bp, Homo sapiens
tggtcggcaaattccttcagtcaccaaactacatagaaatcaacactgtgtttactgagtgtgcggaagttagacagatatgcataaaagggttatttctgttaagccaggatagcagaataagtctctgttgaccctggggaattttccacccggagaacataagtattctggaaccaaagcacactcttcccttcactgtgc

SEQ ID NO: 349808 - DNA, 5227 bp, Homo sapiens
attttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtgcaacacttgcacaatcacggcaactgtttgtaaatatcttttcttctccgccagtatgtagacatgcacacccattcacaagtaagcccgcaaattcattttcacattttcctcttgggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaattta

SEQ ID NO: 349809 - DNA, 5172 bp, Homo sapiens
attttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtgcaacacttgcacaatcacggcaactgtttgtaaatatcttttcttctccgccagtatgtagacatgcacacccattcacaagtaagcccgcaaattcattttcacattttcctcttgggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaattta

SEQ ID NO: 349810 - DNA, 3477 bp, Homo sapiens
cttcccggaattcccggggtctgacccacgtcttccttttgacgcgtgggctggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaattta

SEQ ID NO: 349811 - DNA, 5253 bp, Homo sapiens
attttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtgcaacacttgcacaatcacggcaactgtttgtaaatatcttttcttctccgccagtatgtagacatgcacacccattcacaagtaagcccgcaaattcattttcacattttcctcttgggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaatttacaaaaaaaaaaacttgcccgcgttta

SEQ ID NO: 349812 - DNA, 5443 bp, Homo sapiens
attttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtgcaacacttgcacaatcacggcaactgtttgtaaatatcttttcttctccgccagtatgtagacatgcacacccattcacaagtaagcccgcaaattcattttcacattttcctcttgggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaatgggccgccttttaaaaacgtataaactggaaaacccttggggtacccaaattaaatggctttgaaaaaaatccccttttcccaagttgggaccgccccccccctct

SEQ ID NO: 349813 - DNA, 2188 bp, Homo sapiens
ctctctctctctctctatggctcacgctgtatctgtctctcgatatctctgagtctcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatgggattaactaatgcaagtttacagttgcctcctaaaacacacattctgtataattatcgctaaatacaatgctgtgaggtctatagttcctgtaacccctttctcctccccaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaattta

SEQ ID NO: 349814 - DNA, 4549 bp, Homo sapiens
attttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtgcaacacttgcacaatcacggcaactgtttgtaaatatcttttcttctccgccagtatgtagacatgcacacccattcacaagtaagcccgcaaattcattttcacattttcctcttgggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggtttaaaaagtagtcagttacatagaaagtgtattggtatgtatttgaacctgctcttcattaaacaaacagattagatgtaccctcgactggcaataattgtatctattttcaagtacagctagctgtcaaagcatgaagctcttgtgtatacacactgacacttggttcacgcatgaagaacagtgcctatgcactttgtgtagctataatgtaggtatctaggtgtaatttcagtgaaatggtgtatagatgtattgtaatttaaatgtatatgttatttttggctattcatctaaatgcagtagacatgttgatcggtgttttgcaaacatttctttttccttcttagataactagtcgtgaatcatttctcctctttctcagtgtggcttgggaatatatatgagtgaagaatttatctgtgaatcctttgtactgatgattgtttgaaagtctgtgtgtgtccagcacctttgtaaatacacaattcagagcagggatgggctgggtgtgtgtcctggttcttagtgaaaggtcatctcatgtctgtttaatacatggtgaatgcaactgtggaacttttgattacctagacttaggtaggtttagaatgagaacatccatctacagtcctcctttgcttggtggattgggctcagaggaacaaaaagttagtctgactctgtgcatattagcatcatgtctttagagaaaggtcagcctctctggttgccaaatactcatcatgatgctcatgacttaaaggttctgaggagccttgtctcccttggatttttgagtcagggtacaggaaaaaacattgctgactaactaactgcaaatgcatctgcaggtgaaaccctacgaaagcacagttctggctataaacttcagagttctctgtaaaaaacttagagcactagaagcacaggaatagtgagtgtacagcttatgcggttgtagaggggcaactgatgaacacaggtcccacatatatgagggagtatgacgttctctacctaatatgttctgtgtgcatgttttgaatgattgaagatggaacttttgattacctagacttaggtaggtttagaatgagaacatccatctacagtcctcctttgcttggtggattgcgctcgta

SEQ ID NO: 349815 - DNA, 3536 bp, Homo sapiens
attttcttatgattttccctaaaagaaaaccaaattttctactccacctcttcctttcctatcattccacttattgttgctgctttgctaacagccagcttagtaagccatcacacaagttagtgtgaggcttggttttaaaatagataacagagaatcttgattaaatagtatccaactttgtagcataacacagctaattcaggcaatgacatagagatgataagaaacaacatggtttggtagagggaacatttgatttagactctgcccatttttagctgtatgacttacataagtcattttgtgtccaagcctcattttctcccatatgaaaagtgaaggggttggattaaatgactaaaatccccttccagccctatgagcccaatgtattatgatctctgctttgtttccttcttaagaggcttcctactataaaatgtgacctatttacattttaagttgaagtagcccacaataatgaataatcaatttagatttttctcatctcctttgggagaaattaaattcaagcctctattcatttgatgttttacaacaagcttcaaagttggccatgttcattcacagtttgatattttgagacaccaataaaagttttttaataaaagttcccttgacttaaactcaccttcctaatagaagtagtgatttggctcacggaaaaatgtttccagagtcaacatgagaggactggatgaacctacagcctcactcaagctgttgcatcattgctgctgtagcaacagagccctctctgaatacccaaaacacacaattttctccaacaattctaattgcccacccagtatgggaatttgagagcctttggtgaataaccttgatcactcttttgaaatttggtgcaacacttgcacaatcacggcaactgtttgtaaatatcttttcttctccgccagtatgtagacatgcacacccattcacaagtaagcccgcaaattcattttcacattttcctcttgggtttgtttttatcatgggtatcacattgcaggaagagatgctctaacttacaagaatggaattttctgactatcattgccctcttcaaggcctgattagtttgtagggtggatgggatacaatgcatggtctacaaggtccatgtcaccagccatgatctttaaacaacctcttgcactttctggcactgctgcaatggcccatggtggacacctctgctgtttgtccaaacttctgctaaatagagtagtgttggtatttgttgtgttgtgaactcctttgttgtcagagaagacttcagctcttcaggtttgcaagggcaagatgtaaagctaggactgaaaggattgggttttgtttttcggccggcttttttccattagtgcaaaaaacctgatgcaagggcagcaagataaacacaatttcttcattgacccagataagaacctgtagaaaagtgagagatgcccctaagttcctatttcatttatcctaaataatatcctgaataactactgatcagtttttttctatgtccagccttgcttcactttccaacctccaggccaaatattcattttgatattttacaaaatccttctggtttttacacagggcccttttgtgctgagaataaaaccagctattggaacagacctcactgctttgtagagtcagaagttgacctagagaatgggtagcaacaggtcctcagtttctctggagacacccccaatccttgggtgagtgttgaaacctgacaactgactgttagccttgtcatcatcctcactggagatggagatgttgcagtcggagcctcactccttctggggcactgtttcttctcatggcaaccattttgcctgcctggaaacagcctgttgcctttgctagggggcaaatacacacactagccaaggaagttggtccagcacatctctgaggtttctcccccatggacccatggagcgaattccctgagataaatgatcagaaagttggctgtctggtggtttaatactccataagagttacttcccttatagaaagtcatcctttggcatctagatttttctacaaatcaccttaactccctccctttctctttctcctggaaaacctcagcattgcatctccatgttgcacaacacagatcagattatctggtcactatagagatttgtatataaaaaaactacttttttgaggattttgtatattgtttttctatttgttttctacagcttgaggaaagagctggcaaactgtgaatctaacttgatcttgttgccagcagatatattttggcttcctggtaagagtctgtgttaccagggacaatatattgccctctgatcagtattgcaccctaaatccacaaattcctccagcccagtcttacatttttttaaacaaatcccctagcttgtttgctattatttataaagagcattagaaaatgtatttatagacctggatgttatatgtttaatattaatttagcctttaataatgttataggtttgtaactattcttcagaaattataaagaactcagtgtagactgaattaatctatttagtatctgtaattttgcagacatattttcttacagtattttctatgtaaccacacatgtagaattataactaattagagcacaagaagtttcttcagcaatttagagctaccaattgtttcttgactatatagtcacatttgacaaatttaagaacccagtctttagtgatgcaataaacaaaatgaaccattaagaacaaggaattgcttaaatcccttagctggtgaggatatacatctaaataattcatctttctaactcaaggaatggtgctgattttttaaatgtttgacaccaggccttgtttttccagctgagcattctcattttgcttttctctaagactatcaaagacaaggtattaatagtaggattattcctagatcagaatgtttcatacattcctaaaggtttatgtggaaattggcttaggaaaactttgagtagcagagactgaggatgagtgctagagatgaaatcaggacagatttgttgcagttaattcttgccaagcaaattagtggtaaatgtcacattgttatgtgaattgagcacatatttttaaagaaagtttacaaaaaatttttagaaccaactatgaggcaatactgtatcactgggggctgggagtgggggcttagaatcatactgaaattgtttaaaagcagcccaggtagtttctgtcctcaggtgaataacagactatataacttccccgaaaggtaaaacgatagccactgcagagacgaggtgtcttccttccaccaaatactttctgagatggtggtaggagtagtatttttaccgtggttttgtaacatttcacgtgtaaaataactggatattctttatatactggaaataacctgtgaatccaatatttcactaagtgttttaacttttgtgtatatatctctcatcaataaatgtggatttcaattta

SEQ ID NO: 349816 - DNA, 708 bp, Homo sapiens
tacaataaacatcaaggaatcaatgctcagaagactgcatgagacaccttcttcacaaggacagagaagaactagccatgtgctatagggaaccctgagtgccctactcttttcccaagaagggtaaagcctacaatatcatcagggggcatgaagcacattaatttgcagtggctgcttcatatgaggagatatggtggacaggctaatttttccttgaaaatgtggcttcttcaactcctttcaaatttaggatggaatacttcctgaaataaaactgggctttatgcaggattctctttgaaaattcttgtatgtccagaacaaaagataaaactaattgtattcctcacattcacaatccccattggtctgaagtcacgtagcacagagcatctatagcacatagtgtttaaagactaatgaatgcaaaaagataaaatcttcaactaatttttgaattgtttctcatatatgctactagaaaatgccttgttgatgaagcacattttgggtagttgaggtcttttgttttcgcctttagctttctaagctttcttacaatgtggactgattactgtaacatttcacgtgtaaaataactggatattctttatatactggaaataacctgtgaatccaatatttcactaagtgttttaacttttgtgtatatatctctcatcaataaatgtggatttcaattta

SEQ ID NO: 349817 - DNA, 371 bp, Homo sapiens
tccccgggccagtcggatgtggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtactggcccggggctagtacggatgtgcggtggctgggaggagaggggacaggaggacgaggctgcctctctgctccaaggaaggcactt

SEQ ID NO: 349818 - DNA, 2931 bp, Homo sapiens
agcggggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactcag

SEQ ID NO: 349819 - DNA, 3473 bp, Homo sapiens
  misc_feature (3319)..(3319): n is a, c, g, or t
agcggggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaaggggtgagctagagagagccatggccgctgggtgggctccaggggaggggagctcctctgaaccaaccatcctgtccccactatacacacatgcacacagggggctgttcaagactgaccgggtgctggggacagcccagctgaagctggatgcactggagatagcatgtgaggtccgggagatccttgaggtgagaggtggacattcatccgcgtgctccggtatggccatgctactcgttaacattattaaaacacttcctgccttgagccctctatgagcctgtctgttgacccagcccctcccctcagagcctcagacctccctactgcccagccctaaatacttgcagtaccccactccattatgatcaactggtatctcagccataccatgggctcatattttagaaaccactcttggccaggcatggtggctcatgcctgtaatcccagcactttgggaggctgaggcgggcagatcacgaggtcaggagatcgagaccatcctggctaacatggtgaaaccctgtttctactaaaatacaaaaaaattagccaggcatggtggcgggcgcctgtagtcccagctactcgggaggctgaggcaggagaatggcgtaagtaaacccaggaggcggagcttgcagtgagcccagattgcaccactgcactccagcctggacaacagagcgagactccgtctcaaaaaaaaaaaaaaaaattagtcaggtgcggtggcacacacccgtaatccccagctactcaggaggctgtggtacaagcccaggaggcagaggttgcaatgagccaagatcgtgccactttaaaggggacagctgggtccttggaggggaaagagcntccataggccggtttctcccagccttgggggcgaggcaaaccagaacggacctgggccacagaagtcgttgaggaccctctgtccttatcagaaacgactctgcctggatcagttgggaataagtcgcttgaattatccgcgttactctttttg

SEQ ID NO: 349820 - DNA, 2211 bp, Homo sapiens
aaagtgtttggtgagaattgcttgaaccgggaggcagaggttgcagtgagccaagatcgtgctactgcactccagcctggacgatacagtgatactctgtctcaaaaaagaaaaaaaagggagcccactaaatgaccactgttgtcaccatcagaccctgatccttggggactggactcatcacaggcgctacgaaatctctaacatcctctctcttcctctacagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactcag

SEQ ID NO: 349821 - DNA, 3419 bp, Homo sapiens
agcggggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccaccttaaccccaaagccctcctgcaccccaaagaagccactgaggctggccgagccacactgtctccccaggggcgtcgacctggcccagctgggtccccagggccagcacatggaataaaatagccagggccacactcag

SEQ ID NO: 349822 - DNA, 1421 bp, Homo sapiens
tgggccaaagccaggtcccaggccccctagatttcctgcctcctctctggtcataggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaaggggtgagctagagagagccatggccgctgggtgggctccaggggaggggagctcctctgaaccaaccatcctgtccccactatacacacatgcacacagggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactcag

SEQ ID NO: 349823 - DNA, 1901 bp, Homo sapiens
agcggggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaaggtttgagggttggggccgggcgcagtggctcacacctgtagtcccagcactttgggaatccaagatgggaggatcgcttgaggccaggagtttgagaccatcctgggccacacagtgagacccccgtctctacaaaaaaattttttaaaattagccaggcatggtgggactcacctgtagtccctgctacttgggagactgaggtgggaggatcacctgaactaaggagttcaaggctgcagtgagccatggtcatgccactgtacgccagtctgggtgacagagcaagacctcatctccaagacaattaaa

SEQ ID NO: 349824 - DNA, 3574 bp, Homo sapiens
agcggggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgagttcaaggagcagttcaaactctgcatcaaccgcagccaccgtggcttccgaagggccatccagaccaagggcatcaagttcgaagtggttcacaagggggggctgttcaagactgaccgggtgctggggacagcccagctgaagctggatgcactggagatagcatgtgaggtccgggagatccttgaggtcctggatggtcgccggcccacaggggggcgactggaggtaatggtccggattcgggagccactgacagcccagcagttggagacgacgacagagaggtggctggtcattgaccctgtgccggcagctgtgcccacacaggttgctgggcccaaagggaaggcccctcctgtgcctgcccctgcaagggagtcagggaacagatcagcccggcccctgcatagcctcagtgtgctggcgtttgaccaagagcgtctggagcggaagatcctggccctcaggcaggcgcggcggccggtgcccccagaagtggcccagcagtaccaggacatcatgcaacgcagccagtggcagagggcacagctggagcaggggggtgtgggcatccgacgggaatacgcagcccagctggagcggcagctgcagttctacacggaggctgcccggcgcctgggcaacgatggcagcagggatgctgcaaaggaggcgctctataggcggaatctggtagagagtgagctgcagcggctccgcaggtgaggagcccatggggcgggcagcccccagaaagcgggcagcaggccccgataccgggaagagccgacacagccacgaaccagacaagcagacaatcagcggacaatcggttctggactcacccctcatccgggcccccagccccgccagagcctccgtggctgcgggtgttgggaaccatgcctgccagccagtatgtgcccctcacccaggcctggctgggccctggagagtcctgtttgcacagcccaggggtgtccggcctctggcccgccccggagcagggagggtggctggggccaagccccgagggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactcag

SEQ ID NO: 349825 - DNA, 2535 bp, Homo sapiens
agcggggcagacccggcgagcccagtggccgcgctccggtgcggcggcgcccgaggcccgaggcggaagtgggacggccaagcagggaagcgagggctcgggatcgacggccgcggggcgccgacgaggagtgcaggactcaggaagggcgagtgcgcggcgacagagcccggggaaggaggcagggcaaggccgggcttgggggcaggtggtccgggcatccagccttgaagatgcacaagaggaaaggacccccgggacccccgggcagaggcgccgcggccgcccgccagctgggcctgctggttgacctctccccagatggcctgatgatccctgaggacggggctaacgatgaagaactggaggctgagttcttggctttggtcgggggccagcccccagccctggagaagctcaaaggcaaaggtcccttgccgatggaggccattgagaagatggccagcctgtgcatgagagacccggatgaggatgaggaggaggggacggatgaggacgacttggaggctgatgatgacctgctggcggagctaaatgaggtccttggagaggagcagaaggcttcagagaccccacctcctgtggcccagccgaagcctgaggcccctcatccggggctggagaccaccttgcaggagaggctggcgctctatcagacagcaattgaaagcgccagacaagctggagacagcgccaagatgcggcgctacgatcgggggcttaaaacactggaaaacctgctcgcctccatccgtaagggcaatgccattgacgaagcggacatcccgccgccagtggccataggaaaaggcccggcgtccacgcctacctacagccctgcacccacccagccggcccctagaatcgcgtcagccccagagcccagggtcaccctggagggaccttctgccaccgccccagcctcatctccaggcttggctaagccccagatgcccccaggtccctgcagccctggccctctggcccagttgcagagccgccagcgcgactacaagctggctgccctccacgccaagcagcagggagataccactgctgccgctagacacttccgcgtggctaagagctttgatgctgtcttggaggccctgagccggggtgagcccgtggacctctcctgcctgccccctccacccgaccagctgcccccagacccaccgtcaccaccgtcgcagcctccgacccccgctacggcgccctccacaacagaggtgcccccacccccgaggaccctgctggaggcgctggagcagcggatggagcggtaccaggtggccgcagcccaggccaagagcaagggggaccagcggaaagctcgaatgcacgagcgcatcgtcaagcaataccaagatgccatccgagcccacaaggctggccgagccgtggatgtcgctgaattgcccgtgcccccaggcttccccccaatccagggcctggaggccaccaagcccacccagcagagtctggtgggtgtcctggagactgccatgaagctggccaaccaggatgaaggcccagaggatgaagaggatgaggtgcctaagaagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaaggtgccgcctgcccctgtcaacaaggacgactttgccctggtccagcggcctggcccgggtctgtctcaggaggccgcccggcgctatggtgaactcaccaagctcatacggcagcagcacgagatgtgcctgaaccactcaaaccaattcacccagctgggcaacatcactgaaaccaccaagtttgaaaagttggcggaggactgtaagcggagcatggacattctgaagcaagccttcgtccggggtctccccacgcccaccgcccgctttgagcaaaggaccttcagcgtcatcaagatcttccctgacctcagcagcaacgacatgctcctcttcatcgtgaagggcatcaacttgcccacacccccaggactgtcccctggcgatctggatgtctttgttcggtttgacttcccctatcccaacgtggaagaagctcagaaagacaagaccagtgtgatcaagaacacagactcccctgggcccctgcaagcactttacttcctgttcctccccagccttaaccccaaagccctcctgcaccccaaagaagccactgaggctggccgagccacactgtctccccaggggcgtcgacctggcccagctgggtccccagggccagcacatggaataaaatagccagggccacactcag

SEQ ID NO: 349826 - DNA, 569 bp, Homo sapiens
aaagtgtttggtgagaattgcttgaaccgggaggcagaggttgcagtgagccaagatcgtgctactgcactccagcctggacgatacagtgatactctgtctcaaaaaagaaaaaaaagggagcccactaaatgaccactgttgtcaccatcagaccctgatccttggggactggactcatcacaggcgctacgaaatctctaacatcctctctcttcctctacagcagaacagccctgtggcccccacagcccagcccaaagccccaccctcaagaactccccagtcgggatcagccccaacagccaaagcgccccccaaagccacatccaccagagcccagcagcagctggccttcctagagggccgcaagaagcagctcctgcaggccgcactgcgagccaagcagaaaaacgacgtggagggtgccaagatgcacctgcgccaagccaagggactggagcctatgctggaggcctcgcgcaatgggctgcctgtggacatcaccaagtgccgcctgccctgtcaacaaggagggctgcaaggaggctgacgttggtaccgactca

SEQ ID NO: 349827 - DNA, 1981 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgtt

SEQ ID NO: 349828 - DNA, 924 bp, Homo sapiens
tcggtcggtaccaggtagtgtcgtctttggctgagcgcgcggggaaatggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgtt

SEQ ID NO: 349829 - DNA, 2056 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccggcgtgacgatgactctctcagggccagcccaagccaggtggcgttggaagtgccaaaccgtgggtaaaaaaagcgggtcaaaatcgggcatccgtccttggaagccaaggggataagcgggggacgcggaatgcggtcgcaccggggggccaacggaagggggcggtaacaaag

SEQ ID NO: 349830 - DNA, 812 bp, Homo sapiens
gtgacagaccccaggaccagccctggggctcagggcagccaccccgggccgctgaccgactgacctctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagagccccagggctggcccgtttgggacagctgaccaataaacactgatggtgtgttgtccaaaaaccataaaaaaaaccgggcgctctatgtcggggggggcacaagggttaaagggcctggttatgtccggccctttttttcacaggggatccgggggcccaagggggattatgaaccga

SEQ ID NO: 349831 - DNA, 3053 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggtgagattggcaccgtgtgccggagataggggcgtctgggggtggggtcccgggtctgctcaggagctggggcatgggcacttggaacggggattgctctcccgcccccactattgtacggacgacaacgcggaggcctagcattctctcccagcctagaaactgatccctagtcagccttctaccatctgttgaatgggaagcttagaccgtgatcgggccgcgacgccccgcttccattagtgcgccgaaatagagggtcacttcgtcagctgagacctcccttttctccaggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcaggtctcttgtgccctgttctcttgtccccaccaccaacctatagcaggcaccaaagcaagtgcccggtaaataccaataagaaattaaggaaagaaacaaaccacgacacccaaatgccgtaatcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgtt

SEQ ID NO: 349832 - DNA, 2929 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcaggtctcttgtgccctgttctcttgtccccaccaccaacctatagcaggcaccaaagcaagtgcccggtaaataccaataagaaattaaggaaagaaacaaaccacgacacccaaatgccgtaatcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgttaaacaacacacaacacacccccccacaaacaaccaatacaaaaaaaacagtcagccaccacaagggaccgtgcacgatcgcaagaggcccgaaacacgacacggcggaaaggcgacaccgaccacgcggatgcgcgaatgcgagcgaggcgcgagcagcacggagggaga

SEQ ID NO: 349833 - DNA, 2275 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggtgagattggcaccgtgtgccggagataggggcgtctgggggtggggtcccgggtctgctcaggagctggggcatgggcacttggaacggggattgctctcccgcccccactattgtacggacgacaacgcggaggcctagcattctctcccagcctagaaactgatccctagtcagccttctaccatctgttgaatgggaagcttagaccgtgatcgggccgcgacgccccgcttccattagtgcgccgaaatagagggtcacttcgtcagctgagacctcccttttctccaggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgtt

SEQ ID NO: 349834 - DNA, 2878 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcaggtctcttgtgccctgttctcttgtccccaccaccaacctatagcaggcaccaaagcaagtgcccggtaaataccaataagaaattaaggaaagaaacaaaccacgacacccaaatgccgtaatcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgttaaaaaattctcctgtagtttatgcaacctttaaccttgagggggggcccggtaccaaattcgccctattgggattagcattacatattcactggcctacggtttactacgttttgactg

SEQ ID NO: 349835 - DNA, 2676 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcaggtctcttgtgccctgttctcttgtccccaccaccaacctatagcaggcaccaaagcaagtgcccggtaaataccaataagaaattaaggaaagaaacaaaccacgacacccaaatgccgtaatcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagagccccagggctggcccgtttgggacagctgaccaataaacactgatggtgtgtt

SEQ ID NO: 349836 - DNA, 2627 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcaggtctcttgtgccctgttctcttgtccccaccaccaacctatagcaggcaccaaagcaagtgcccggtaaataccaataagaaattaaggaaagaaacaaaccacgacacccaaatgccgtaatcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccaggccccagggctggcccgtttgggacagctgaccaataaacactgatggtgtgtt

SEQ ID NO: 349837 - DNA, 1809 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggtgagattggcaccgtgtgccggagataggggcgtctgggggtggggtcccgggtctgctcaggagctggggcatgggcacttggaacggggattgctctcccgcccccactattgtacggacgacaacgcggaggcctagcattctctcccagcctagaaactgatccctagtcagccttctaccatctgttgaatgggaagcttagaccgtgatcgggccgcgacgccccgcttccattagtgcgccgaaatagagggtcacttcgtcagctgagacctcccttttctccaggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgtt

SEQ ID NO: 349838 - DNA, 3701 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcaggtctcttgtgccctgttctcttgtccccaccaccaacctatagcaggcaccaaagcaagtgcccggtaaataccaataagaaattaaggaaagaaacaaaccacgacacccaaatgccgtaatcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtgggtaagtcatcacctcctccccttgaccctgggcagggtttcgggaagaccccacctctgaacatgcttccacactttggcggtgctggaagctgcttgccccgaactcacccgtggggttttcctgttcatccttcgaggctgccagtcagtaacctctgggtttcctggtgccccaggctttttggactccaatgacctgtctacctctttcctgccccaaccccatcatcactctgctcacacctcagtcaccctcttgtcaccctggcttctaattcctgcacctctctctctcatggcttcctagggatggggactgtgtctccatcattactgcacatctagaacaggctgtggcactgaggctgtgctcagaaagtcatttggatgagtcagtcaacagccgggtgcctggatgatgggtggatggatgggtgggtgggtgaggtgtaggaggaggtgggtaggtatgtaggtgggcagacaagtggttgaccgggtgatcgatagatgggtggatcttgttccccttggaatctgaaacactaaatgcagcatcttgcttgaggcaggcactcagttggtgtttgttgagtgaatgtgagtagacatatgccttgacgaatgactagggagataagcaggttccctggaggatggttgggtaggttcacagccctgtgtgtgggtggctctgctgtgtcatgccctggcctcccagcagccctgagcttagatcttatgtggcctttctggtctgtgtatcccaggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgttaaacaacacacaacacacccccccacaaacaaccaatacaaaaaaaacagtcagccaccacaagggaccgtgcacgatcgcaagaggcccgaaacacgacacggcggaaaggcgacaccgaccacgcggatgcgcgaatgcgagcgaggcgcgagcagcacggagggaga

SEQ ID NO: 349839 - DNA, 3103 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttggtatgtcattctccccgtccgctgctcaccttccccgagccctggcaccgccagagcaactactatataggctctaggcacggcgctggcttcattgcctgcctcatctcttgaactctccagaacaactctatgaggaagatgccagtggtaccgcattttatagatgagatagctgaggctaggggagaaggatctggcccaagattgcatccttagccgctacacttataactctgtttccggcttgctttgacttttgggggagttctgttccttctgggttagcctgctgactcttaggcatggcaaacgccagtgatatttgtgaaggcctttaggatatttttttcttgtgggaaaacttgttggttattgcttaagaagtgcagtgtgtctggaagtgcagaacttggtatcctttagagaaaaaatattagtgaagaagccctggaggcccaggttgggagtcagtcgaggattcctcaagtaccatttgctaggctgtgaggtgccttagggcaggtctcttgtgccctgttctcttgtccccaccaccaacctatagcaggcaccaaagcaagtgcccggtaaataccaataagaaattaaggaaagaaacaaaccacgacacccaaatgccgtaatcttaaagaaaagcaaatgcagtcccagtcctctgaatgggtcagccccttagatggaggaggtgggacgtttgggcttgggggctcggcaaggcaagcaagacacaccagagctcttccctcgatgccagccattcatcgacagtcagcatgtcatccacaagtatttcctgccccgagcctatgctgtcgccatcccactggctgcaggcctcctgctgctcctgtttgtgggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggtgtcatgggcaagccgagcgccggggtcgcattacctgatcctgagcgtctatgaatcactgagatgcgcctcaagtcccgcaataatgtaccaagtggtgatggacactgtggaggggatctagcattgagcgaattagagagcacgtgaatgggcgcctgttaaccaatataggatgccgacacgtgaaaataccacgcggggtcacatatcagatcaaggcgtggaggagacgtcacacataggcgatcacaagagacaagggagagaaacgggacccaagggatgggtagggaacgtacgcgcacattcggtcaggccggataaagaccgtggataccattctttcagacccgtaacttaacaacaacggaccatgggagattgcaattcctcaattgaggtaatggtcgcatcacatcacccagatcacgggtggactacaccatttaccacacaa

SEQ ID NO: 349840 - DNA, 2923 bp, Homo sapiens
tctttctttgggccaagcctccactgaggtgccaggatacagcagcaacctcagaccctaccctcggggctgacagggctggatcaacaatgcatcagtgaattaaaaggcacaggaggctgggcaccgtggctcacgcctgtaaacttttggaggccgagtgggaggatcgcttgagcccaggagttcgacaccagcctggataacatagaactccgtctcaaaaacaaacaaacaaacaaaaaaaacgttcccgactggcttccctgaggaacgtggcgtcccagtgagaccggatgggtgaggagcagccggcctgtgagtggtgggggaccgcgttcctatctcggagctgaagaagcgtggaagatgatctggcccaacatctctttgttctcagaggaagggccttccaagaccggggaggggcctgtgcgtgggtcccggtccgaaacgtgtctgggctgctgcgagagacagtcggtgaaggaagggaggggacatccgaagggtggcccgggaggccgggcgatggtgaggagggcgcctcctctccaccaaatcctccccatccatgcgggctagggacagaccctcccccgccaccctaggctggaaagtgaacgttctctgcacctctcccacctacagactaagtagggcacccggtttccgtgtcggcttcaccactgactcggaatgggatctacctttctctgagcctcacttttcccatctgaaaaatggaacttccgatcccgcactcccatcccactctggccccgggactctgggatacttagagattggcttttggtggggcggcgacaggactgtggccatgaaggccagggagtctgggtccccaactcggtcccattccctagagagattcgggcagcaaccggccccacaatgctcttgagaactacacttcgccgatatgcaaagaagaggaggcggttcctgctcgtctccgacgaggtgggcccgagcaggcctggggactacgactcccggcgtgctccgcagtccaaagccggaagagcgtggacccggaaccggatgtggcttgcggctcgggtggctgagcgcgcggggaaatggccacggggacagaccaggtggtgggactcggcctcgtcgccgttagcctgatcatcttcacctactacaccgcctgggtgattctcttgccattcatcgacagtcagcatgtcatccacaagtatttcctgccccgagcctatgctgtcgccatcccactggctgcaggcctcctgctgctcctgtttgtgggtaagtcatcacctcctccccttgaccctgggcagggtttcgggaagaccccacctctgaacatgcttccacactttggcggtgctggaagctgcttgccccgaactcacccgtggggttttcctgttcatccttcgaggctgccagtcagtaacctctgggtttcctggtgccccaggctttttggactccaatgacctgtctacctctttcctgccccaaccccatcatcactctgctcacacctcagtcaccctcttgtcaccctggcttctaattcctgcacctctctctctcatggcttcctagggatggggactgtgtctccatcattactgcacatctagaacaggctgtggcactgaggctgtgctcagaaagtcatttggatgagtcagtcaacagccgggtgcctggatgatgggtggatggatgggtgggtgggtgaggtgtaggaggaggtgggtaggtatgtaggtgggcagacaagtggttgaccgggtgatcgatagatgggtggatcttgttccccttggaatctgaaacactaaatgcagcatcttgcttgaggcaggcactcagttggtgtttgttgagtgaatgtgagtagacatatgccttgacgaatgactagggagataagcaggttccctggaggatggttgggtaggttcacagccctgtgtgtgggtggctctgctgtgtcatgccctggcctcccagcagccctgagcttagatcttatgtggcctttctggtctgtgtatcccaggactgttcatctcctacgtgatgctgaagagcaagagagtgaccaagaaggctcagtgaaggtcccgcagggatgaggctgccagccccttctctgcttcccctccagcacagggaccaagtgggggagcctgcagaacctgtccaggcacagtggctcctcaagcctgcctgtcctgcagagtccccatggcatggagcttacacctgactgactggagccccctccccgactcccacttccagaagctaggagggagggatacctggaagactccggtcacctccttcttgctcagggcctaaaagatgctggtcctcccaacctcactctcagactccctgccaccttttcccctgggttctgccgtcttgcctcacttcccctcctgtcacatgctgacgttggacttagcaggttctaaggccacatgtgtgacctctctgacttctcttcctccaccaaggcagctttccttaccctgacacagccccagaccccacaaagccttctggacctggaaagcctggggaaggactgacagaccccaggaccagccctggggctcagggcagccaccccgggccgctgaccgactgacctctcctcacggaggcccagccccaaagccccagggctggcccgtttgggacagctgaccaataaacactgatggtgtgttaaacaacacacaacacacccccccacaaacaaccaatacaaaaaaaacagtcagccaccacaagggaccgtgcacgatcgcaagaggcccgaaacacgacacggcggaaaggcgacaccgaccacgcggatgcgcgaatgcgagcgaggcgcgagcagcacggagggaga

SEQ ID NO: 349841 - DNA, 2190 bp, Homo sapiens
gctacaaggagggtcgacccaggtgccactgccccctcagcactcaccatggcgactccccagagcctgcagcaagcagcacccgccccgcgcgtagcctcccgcggtcatgtgacgctgcggcccctccaagccccgccctctctagccccgcccccgggccctacaggcggctcattgattggcctacttctaggaacccgagtctcgcgtgcttattggccctgtcacttaacgctagatggacggacctgagcgccagccaatctcaccacagcgtgcgagagtgggcggagcagtgcagggcagtggggatcgcccggcggcaggcaggagacaacaggagggaaaggcagtgtgtgatgagtttgtcaagaaggaatggaaggagggggagccgacaagtccacgttcaccgcatctgcgttggcgattgcgctattgatgcgcatgcgcaaaaggaagaccctgattggtttgtgggacggtctcaacgtcctgtcctaaccaatccagatgcgccgggggtggggcctggctctcactggccggtgcagcctttgcgcgcgggtttcgttgacccgcggcgttcacgggaattgttcgctttagtgccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgca

SEQ ID NO: 349842 - DNA, 791 bp, Homo sapiens
cagttttccaagcaatcagtaatggaagtaacatcgttattgggtaattaagaatatggctggtctggcacagtggcttattcctgtaatcccagcactttgggaggctgaggcgggaggattgcttgagcccatgagtgcgagaccagcctgggcagctacagctaggtatttgtcttaaacctgggcatggtctgatgggaagtccctagttgtataacaagtcagctggttggctgtttgtgattggctggggattatttttgtctttcggaggttcttttcccccgacaaaagaaatgtttccaagttaggttccagtttgcttataagagctttagctacaaagacaatctcaggcaaatggctgcattattgttttaataccacctactggctatgtgattttttggtttttttgtttgtttgtttgattttggttttttggtttctctttttcgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgca

SEQ ID NO: 349843 - DNA, 2249 bp, Homo sapiens
gctacaaggagggtcgacccaggtgccactgccccctcagcactcaccatggcgactccccagagcctgcagcaagcagcacccgccccgcgcgtagcctcccgcggtcatgtgacgctgcggcccctccaagccccgccctctctagccccgcccccgggccctacaggcggctcattgattggcctacttctaggaacccgagtctcgcgtgcttattggccctgtcacttaacgctagatggacggacctgagcgccagccaatctcaccacagcgtgcgagagtgggcggagcagtgcagggcagtggggatcgcccggcggcaggcaggagacaacaggagggaaaggcagtgtgtgatgagtttgtcaagaaggaatggaaggagggggagccgacaagtccacgttcaccgcatctgcgttggcgattgcgctattgatgcgcatgcgcaaaaggaagaccctgattggtttgtgggacggtctcaacgtcctgtcctaaccaatccagatgcgccgggggtggggcctggctctcactggccggtgcagcctttgcgcgcgggtttcgttgacccgcggcgttcacgggaattgttcgctttagtgccggcgccatggggtcggagctgatcgggcgcctagccccgcgcctgggcctcgccgagcccgacatgctgaggtgagttcggccgcgcaagaccagggctgggcttccgcctcgcggccctgggccctcaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgca

SEQ ID NO: 349844 - DNA, 1267 bp, Homo sapiens
aggtacatacctaggagtattaattggcatttatggaaaacatctcttcaattcaacaaaagtatgtgcatatacggagggagtgcagctgatattgtagaaaacagtgagaatagtcaactctacttttgaaaccatattacgctgagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgca

SEQ ID NO: 349845 - DNA, 808 bp, Homo sapiens
  misc_feature (27)..(27): n is a, c, g, or t
  misc_feature (30)..(30): n is a, c, g, or t
ctgtccggaggattcctggctgtcatnagnttgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgca

SEQ ID NO: 349846 - DNA, 356 bp, Homo sapiens
caactctacttttgaaaccatattacgctgagtaagaaaaggtcttgacaggtctattctgaagaaaaagtttattttgtgtttgtaattagtggttgctgtggagtcttattaggaaagtttattttcagggtggggtggggttgttacattcctgtaatataaatatcctgtgagttaaaatgagtggaacaaaaaagtcctatgattgtcattcattaaattaatctgagatttactaaagagttctaaaagtcatgaagcactacagcaaatgtcttttatgtgccccttttgttataaaatagatcccatgtgcattttaactctcagtccaataaacaactaaacaactt

SEQ ID NO: 349847 - DNA, 533 bp, Homo sapiens
ttctctccttccttttcccaataaattacacgttagcacctttgtataaacacaagtaaccatctgtgtgtttcctgtggttttttactgcctattttgactatattaatattgtgttataattttaaatcatctgtgcatatgcatgactgcctgcctttgcatagtttgaactctttgaaagcagtacttcctcagcctgacatgattaccagttttttgactaaatgaagctaaacctttaggtagagtgacttgccacaaaattaattttgaaaagttatactgcttattaaacaagtgtttaagggtactaatatatagaacttaaggtttttatgatttgtgtatgtgtttttcctttcacaggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaag

SEQ ID NO: 349848 - DNA, 2512 bp, Homo sapiens
gctacaaggagggtcgacccaggtgccactgccccctcagcactcaccatggcgactccccagagcctgcagcaagcagcacccgccccgcgcgtagcctcccgcggtcatgtgacgctgcggcccctccaagccccgccctctctagccccgcccccgggccctacaggcggctcattgattggcctacttctaggaacccgagtctcgcgtgcttattggccctgtcacttaacgctagatggacggacctgagcgccagccaatctcaccacagcgtgcgagagtgggcggagcagtgcagggcagtggggatcgcccggcggcaggcaggagacaacaggagggaaaggcagtgtgtgatgagtttgtcaagaaggaatggaaggagggggagccgacaagtccacgttcaccgcatctgcgttggcgattgcgctattgatgcgcatgcgcaaaaggaagaccctgattggtttgtgggacggtctcaacgtcctgtcctaaccaatccagatgcgccgggggtggggcctggctctcactggccggtgcagcctttgcgcgcgggtttcgttgacccgcggcgttcacgggaattgttcgctttagtgccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgcaaaaaaaaaaaaaaaaaaaaaaaacttgtgggggcgcagggccacggaaaaatttaccagacacaacgggtggggggcggcccagaggtaatgggacaagggccacggtgcccaaaggaacctgggccaaacaggcggggttcacaaaaaaacgccgggaccggcgtccgacacccgagggttcgggtgcagatcacacagggcagcgactactccccccgaggcgggagaaaagcagcaagagcgagagcaggagaacgcccggcaacgacacagaccacagcacacgagaagacgcggagcggcgagagacagaagaacag

SEQ ID NO: 349849 - DNA, 1708 bp, Homo sapiens
aagcatttgagcacagtgatgtttggagtcagtgctggttctgtcttcctctcaccagaggatatgaccttcattcccagccccagataaacgagccacaggagttaggcttagtgtgaagctaaccaggctgtattcattgtttaccaacgtgttgagcaaacttctgaataagttgtagcgaacacactgcccttttaaccaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagattctaaagctgaaagtggataaaaacaaaatggtagccacatccggtgtaaaaaaagctatatttgatcgactgtgtaaacaactagagaagattggacagcaggtcgacagagaacctggagatgtagctactccaccacggaagagaaagaagatagtggttgaagccccagcaaaggaaatggagaaggtagaggagatgccacataaaccacagaaagatgaagatctgacacaggattatgaagaatggaaaagaaaaattttggaaaatgctgccagtgctcaaaaggctacagcagagtgatttcagcttccaaactggtatacattccaaactgatagtacattgccatctccaggaagacttgacggctttgggattttgtttaaacttttataataaggatcctaagactgttgcctttaaatagcaaagcagcctacctggaggctaagtctgggcagtgggctggcccctggtgtgagcattagaccagccacagtgcctgattggtatagccttatgtgctttcctacaaaatggaattggaggccgggcgcagtggctcacgcctgtaatcccagcactttgggaggccaaggtgggtggatcacctgaggtcaggagctcgagaccagcctggccaacatggtgaaaccccatctctactaaaaatacaaaaattagccaggtgtgatggtgcatgcctgtaatcccagctcctcagtaggctgagacaggagcatcacttgaacgtgggaggcagaggttgcagtgagccgagattgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgca

SEQ ID NO: 349850 - DNA, 2553 bp, Homo sapiens
  misc_feature (1741)..(1741): n is a, c, g, or t
  misc_feature (1744)..(1744): n is a, c, g, or t
  misc_feature (1768)..(1768): n is a, c, g, or t
  misc_feature (1893)..(1893): n is a, c, g, or t
  misc_feature (2260)..(2260): n is a, c, g, or t
  misc_feature (2401)..(2401): n is a, c, g, or t
  misc_feature (2450)..(2450): n is a, c, g, or t
  misc_feature (2460)..(2460): n is a, c, g, or t
  misc_feature (2521)..(2521): n is a, c, g, or t
gctacaaggagggtcgacccaggtgccactgccccctcagcactcaccatggcgactccccagagcctgcagcaagcagcacccgccccgcgcgtagcctcccgcggtcatgtgacgctgcggcccctccaagccccgccctctctagccccgcccccgggccctacaggcggctcattgattggcctacttctaggaacccgagtctcgcgtgcttattggccctgtcacttaacgctagatggacggacctgagcgccagccaatctcaccacagcgtgcgagagtgggcggagcagtgcagggcagtggggatcgcccggcggcaggcaggagacaacaggagggaaaggcagtgtgtgatgagtttgtcaagaaggaatggaaggagggggagccgacaagtccacgttcaccgcatctgcgttggcgattgcgctattgatgcgcatgcgcaaaaggaagaccctgattggtttgtgggacggtctcaacgtcctgtcctaaccaatccagatgcgccgggggtggggcctggctctcactggccggtgcagcctttgcgcgcgggtttcgttgacccgcggcgttcacgggaattgttcgctttagtgccggcgccatggggtcggagctgatcgggcgcctagccccgcgcctgggcctcgccgagcccgacatgctgaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggcttatttaattaaactttctggtttgaacaaggagacatatcagagctgtcttaaatcttttgagtgtttactgggcctgaattcaaatattggaataagagacctagctgtacagtttagctgtatagaagcagtgaacatggcttcaaagatactaaaaagctatgagtccagtcttccccagacacagcaagtggatcttgacttatccaggccacttttcacttctgctgcactgctttcagcatgcaagtaggtatttcattaaacattcagaaaagttaccaatttacaagtgggtttttcatccccaaggaatacttctaacttagttgatatcaattcagagcatattttcccctagaaataatattaggaatattggccaagtgactatattcccagtttatcccataatgtagctaacaacttggaactagtgttgccagaattccactagcaaatagcagctgtatatatatgctgggaattctgatttcagtctgccttttgtaagagatgatatctgtcattaaaacagtcttcacatgtgatttttctgctcatattttttaaaaagtactggttgggccaggcgtggtggctcccgcctgtaatcccaacactgggaggcagaggcaggaggactgcttgaggcaaggagttcaagactagcctagacagcataataagaccccaatctcttaagaaaaaaaaaaaaaattagctgggtgtcagcacatgcctccagtcctggcttctcagctactcgggaggctgaagctgaaggctcactggagcctaggagttcttggttatagtgagctatggtcacgctactacactgcagcctaggcaacacagcaacactgtctcttttttttttttttttttttttacattttttttatttttatttttnttnttttttttttaatttatttttttnttgataattcttgggtgtttctcacagagggggatttggcagggtcatgggacaatagtggagggaaggtcagcagataaacaagtgaacaaaggtctctggttttcctaggcagaggaccctgnggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccacaaagctgccattgtcatcctggcccgttctcaatgagctgtngggcatacctcccagacggggtggtggccgggcagaggggctcctcacttcccagtaggggcggccgggcagaggcgcccctcacctcccggacggggcggctggccgggcgggggggctgaccccccccacctccttccnggacggggcggctggccgggcggggggctgacccccccacctccctccnggacggggcngctggccgggcagaggggctcctcacttcccagtaggggcggccggggcggctggccgggnggggggctgacccccccacaacactgtctctt

SEQ ID NO: 349851 - DNA, 2007 bp, Homo sapiens
cctttgcgcgccgggttaatgggcggtaatttggtacccttgggtgcactttgttttgcccctgttcatttgaatgcaaatgggtgacccgggcccgactaggtgcttattaaattgcagttttcccccctgccttttccggaatgcagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaacagaatcattagtgcgcgttttt

SEQ ID NO: 349852 - DNA, 710 bp, Homo sapiens
agtcggtttattcaacgaatgcctgtggagcagtttcgaggtgcacccaccactagaatttgaacatcctaagaacaggtatttttgtctctgctttgctgatgtatcctcagcaaccggaactgcctgacatctgatcctttctgtgagacaccaggctgttgaggaagaatctatggcaacattgtatctattaatatacagcttctgtatttatcaggcccagttctggtgatgatttcacttttgacagaagctgtccctcaaaagcaaacatgcaatagaagaaacagatctcagtaagtagcttattttccttacaaacactactgaaatttcttattaatgctcctaattttcccattatgcactgcagcgtgagtatggctccagaggctgcacctaataacttccttgagctctaatgattattggtatcttttactaatgtgtatctgttctaaactacacaaaagcatacaaagccatctccctcttttaaaaacttgaaaatgtgggtatcacctttaattaaatattttaaatttctctctccaaatcagatttatctatgtgtgggagtttagatagtcccaagacttttgctaatacagtatttccaatttaatcttaagtagaaaaatgtatgtaattaagagatttattataaaacatttggcaaagaaggaaagaaaacagtaactatgtag

SEQ ID NO: 349853 - DNA, 665 bp, Homo sapiens
aaaagttcgtgaggtgtagtcgcggcaaccaggaggtgcacccaccactagaatttgaacatcctaagaacaggtatttttgtctctgctttgctgatgtatcctcagcaaccggaactgcctgacatctgatcctttctgtgagacaccaggctgttgaggaagaatctatggcaacattgtatctattaatatacagcttctgtatttatcaggcccagttctggtgatgatttcacttttgacagaagctgtccctcaaaagcaaacatgcaatagaagaaacagatctcaatgccatccatctgcagttgtgacaagcaaaaaagtctccagacatggccaaatgtcccctggggggcaaaatcacccccaattgagaactactgctctaaactcttgatggtcctttggaaagccatcccttgttcggcttcagtccaaggtttcgatggcaatggtactgatcctacttctgagctccagagttaaatataagacctaggcctgacaagaatgttccatccttttggccaccagacgactccggggtatggacaaatgacagaagtcagtaataagagatgccatgctgggacttaagtggaactattagagaagaaagattcccttcgcactggggtggagacatgtaagtctaccat

SEQ ID NO: 349854 - DNA, 3400 bp, Homo sapiens
tcgagtcggcaatatacagcttctgtatttatcaggcccagttctggtgatgatttcacttttgacagaagctgtccctcaaaagcaaacatgcaatagaagaaacagatctcaatggagtctcactctgtcacccaggatggagtacagtggcgtgatctcggctcactgcaagctccgcctcctgggttcatgccattctcctgccttagcctcccgagtagctgggactacaggcgcctgccaccacgcccggctaatttttgtatttttagtagagacagggtttcaccgcattagccaggatggtctcgatctcctgacctcgtgatccgcccgcctcagcctcccaaagtgctgggattacaggcgtgagtcactgtgcccagccaagtttagtattttttgtagagacagagtttcaccatgttggccaggctggtcttgcactcatggcctcaagtgatccacctgcctcggcctccgaaagtgccgggattacaggcgtaagccactgtgcctggccttaaatgggtaaatttcatatggtatatgaattatatttcactaaaactttaagaaaacattatacagtactgttcaaattttaagtggtccaatttaaatgcactattgtatacaattctatgtaatgtccttaccatggtatatgttaactataaatatctatgcccctacccttagtatcaaagcatatattatatgccagtgagccaagccccacatgtctgtgaaatgtggtcttctagccatagaagtagcttgtgctcctagggtattccttgaggctctgtatgaagaatgtccatttgtttgagtccctaacctacagaatattcctgaccatggaaatgtgatagataggagtaagcacatggaccaaaaggcctggaggctcatcatttaaggtacaagccaattatgtagtctttgaaagaatgctttgaaattcagcttgcttgattcaattcccaatattttcatttgtattaaaagatttggcccttacaggttaaaaacaatgtcagtgtaaccaagtgacattcaaattttggcttcccaacatgtgatatgacatcacttcatgtgaaaatagcgaagctccaaacattttctttcagtcaccttattaagctcgctgagccctgacagcctaatgaaaggctaagggggaagaaaatgtcccaacttctacactgttgaagatgggctaatgagaggttagcttgcaagaatcattctttcttggcatcctgcttctgactgcttggctttcagcttatacccagcatgaaaatttaatttcctcgcagttgaaggtagtttaaagcttattactcacatgctaaaatgttgatgtatctgtttttgtgcttgttttctggatgattggaatgctctgcagtgatgttcatatcagcagtacagcgctggacttcctagtgaagaaaacagcaagattatagacacagtttagaaacaaaggaacaccatatacatttaaaggcataaagtatttactcactccctggccacagccaccgttaccttctcaatcccaacttcggatataattattgatatatttataacgagtttatgaagaatgtgaaaaaggtataaagatttcattatttactatttcatcaatcatctacttttttctagtttttgacctagtccctgagatgtaaaacaatatctctttttgaatacatcatagtctatgggtgagaaaaatattcaaaaagatagtcaaacatgatgaatacaaaagaggcctgagaaagctctgatgggagcacagaacagaggaaggctttagacaggtgaaaaaatttacctaagtcttaaaggaagaaagggaatttctaagaagtataatctctaccatgatttgcaatatgcttacaggccttatagcctcattttataattgtgagggtgcattgactctaaagactcagtgctgaaataaccctaataacagcccaactaatggtcatatctcatatatacagtcttgacaaattatttgtgaactctagtattttaaaagttatccttctttggaaaaatagcagtagcagaaataacactcttatcctaccttggccgtggatttaaacgtcatccattagcctaatacaacgttgctgaaaagccaaatttttctacactatatgcttcaaacccaagaaagtactggagctgactaataagggaagtcattagcagtacacagctgctacaaagagcctgaacaaagtaacacaaaattatcaggagaaatgttttacacagaacagatgtagcagagtttagaagcatgcagactttttttttccacaaaggagttgcctagtaattatgcatgttttccatagtatttacattaaacataatgaaaacaatgaactggttgtcttttatattcacaaagtacttccccagggagaagtacacttcttctctagaaggaggaagttactgtactcaaagaatttaaggtataaaagcaaagaatttctgtgtgttcaaagaaacagtattcaatgactctccaattgttggacactgtaaattgaagtttccataattatagtccttcccagctgtccatttaaaaaaaaaaaaaaaagccccacaggcattaattcaatccacctttctgggaaagtgtgtttaatgacagttcttaccctttccttactcttactaaactccaatatattctgttctaacatagtttataacctatggtttggaaaacactggtttaaggagctttaaggctgccctttggctcttctctaaaatgagataataaagtgtgatcacaaatcagtctacgtaagaacatgagcaatgctagccaaacttagcacgttgggacctgccttttgaaactgccttataagctctgagccatgctcttttgaagagtttcaagggcagacaacttttgaaaatggatttgaaacaagttagtcttttgttttcgggttttgaaggtcacacctttggcatgtacttctttagggttgagttgttcaggtatcttatgctgagagattttggcttttagtaccttagtctgagatttactttgtttattgatttttttttcctgttgtatagatctgaccaccctagctatggactgaagttggagcctcttttctaatataatgcaattgaccaagactgcttgggagcagctgtcagtattgtttaaagctgtcattcaatatggccaaactctttgttatctaaaaccccttgtctgatctgttgcctctgtttcacttttccaattagatgaatgacagaaacaaaaaatcgtaataaatattgtcaaatctgattttaatagaac

SEQ ID NO: 349855 - DNA, 4811 bp, Homo sapiens
ggcggtggtggcggcggccggcaggcgcgggggaacacaggggccgctacgggagccgcgccgccgcccatgtcattccacttcaagtgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggtgcacccaccactagaatttgaacatcctaagaacaggtatttttgtctctgctttgctgatgtatcctcagcaaccggaactgcctgacatctgatcctttctgtgagacaccaggctgttgaggaagaatctatggcaacattgtatctattaatatacagcttctgtatttatcaggcccagttctggtgatgatttcacttttgacagaagctgtccctcaaaagcaaacatgcaatagaagaaacagatctcaatggagtctcactctgtcacccaggatggagtacagtggcgtgatctcggctcactgcaagctccgcctcctgggttcatgccattctcctgccttagcctcccgagtagctgggactacaggcgcctgccaccacgcccggctaatttttgtatttttagtagagacagggtttcaccgcattagccaggatggtctcgatctcctgacctcgtgatccgcccgcctcagcctcccaaagtgctgggattacaggcgtgagtcactgtgcccagccaagtttagtattttttgtagagacagagtttcaccatgttggccaggctggtcttgcactcatggcctcaagtgatccacctgcctcggcctccgaaagtgccgggattacaggcgtaagccactgtgcctggccttaaatgggtaaatttcatatggtatatgaattatatttcactaaaactttaagaaaacattatacagtactgttcaaattttaagtggtccaatttaaatgcactattgtatacaattctatgtaatgtccttaccatggtatatgttaactataaatatctatgcccctacccttagtatcaaagcatatattatatgccagtgagccaagccccacatgtctgtgaaatgtggtcttctagccatagaagtagcttgtgctcctagggtattccttgaggctctgtatgaagaatgtccatttgtttgagtccctaacctacagaatattcctgaccatggaaatgtgatagataggagtaagcacatggaccaaaaggcctggaggctcatcatttaaggtacaagccaattatgtagtctttgaaagaatgctttgaaattcagcttgcttgattcaattcccaatattttcatttgtattaaaagatttggcccttacaggttaaaaacaatgtcagtgtaaccaagtgacattcaaattttggcttcccaacatgtgatatgacatcacttcatgtgaaaatagcgaagctccaaacattttctttcagtcaccttattaagctcgctgagccctgacagcctaatgaaaggctaagggggaagaaaatgtcccaacttctacactgttgaagatgggctaatgagaggttagcttgcaagaatcattctttcttggcatcctgcttctgactgcttggctttcagcttatacccagcatgaaaatttaatttcctcgcagttgaaggtagtttaaagcttattactcacatgctaaaatgttgatgtatctgtttttgtgcttgttttctggatgattggaatgctctgcagtgatgttcatatcagcagtacagcgctggacttcctagtgaagaaaacagcaagattatagacacagtttagaaacaaaggaacaccatatacatttaaaggcataaagtatttactcactccctggccacagccaccgttaccttctcaatcccaacttcggatataattattgatatatttataacgagtttatgaagaatgtgaaaaaggtataaagatttcattatttactatttcatcaatcatctacttttttctagtttttgacctagtccctgagatgtaaaacaatatctctttttgaatacatcatagtctatgggtgagaaaaatattcaaaaagatagtcaaacatgatgaatacaaaagaggcctgagaaagctctgatgggagcacagaacagaggaaggctttagacaggtgaaaaaatttacctaagtcttaaaggaagaaagggaatttctaagaagtataatctctaccatgatttgcaatatgcttacaggccttatagcctcattttataattgtgagggtgcattgactctaaagactcagtgctgaaataaccctaataacagcccaactaatggtcatatctcatatatacagtcttgacaaattatttgtgaactctagtattttaaaagttatccttctttggaaaaatagcagtagcagaaataacactcttatcctaccttggccgtggatttaaacgtcatccattagcctaatacaacgttgctgaaaagccaaatttttctacactatatgcttcaaacccaagaaagtactggagctgactaataagggaagtcattagcagtacacagctgctacaaagagcctgaacaaagtaacacaaaattatcaggagaaatgttttacacagaacagatgtagcagagtttagaagcatgcagactttttttttccacaaaggagttgcctagtaattatgcatgttttccatagtatttacattaaacataatgaaaacaatgaactggttgtcttttatattcacaaagtacttccccagggagaagtacacttcttctctagaaggaggaagttactgtactcaaagaatttaaggtataaaagcaaagaatttctgtgtgttcaaagaaacagtattcaatgactctccaattgttggacactgtaaattgaagtttccataattatagtccttcccagctgtccatttaaaaaaaaaaaaaaaagccccacaggcattaattcaatccacctttctgggaaagtgtgtttaatgacagttcttaccctttccttactcttactaaactccaatatattctgttctaacatagtttataacctatggtttggaaaacactggtttaaggagctttaaggctgccctttggctcttctctaaaatgagataataaagtgtgatcacaaatcagtctacgtaagaacatgagcaatgctagccaaacttagcacgttgggacctgccttttgaaactgccttataagctctgagccatgctcttttgaagagtttcaagggcagacaacttttgaaaatggatttgaaacaagttagtcttttgttttcgggttttgaaggtcacacctttggcatgtacttctttagggttgagttgttcaggtatcttatgctgagagattttggcttttagtaccttagtctgagatttactttgtttattgatttttttttcctgttgtatagatctgaccaccctagctatggactgaagttggagcctcttttctaatataatgcaattgaccaagactgcttgggagcagctgtcagtattgtttaaagctgtcattcaatatggccaaactctttgttatctaaaaccccttgtctgatctgttgcctctgtttcacttttccaattagatgaatgacagaaacaaaaaatcgtaataaatattgtcaaatctgattttaatagaac

SEQ ID NO: 349856 - DNA, 1790 bp, Homo sapiens
ggcggtggtggcggcggccggcaggcgcgggggaacacaggggccgctacgggagccgcgccgccgcccatgtcattccacttcaagtgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggtgcacccaccactagaatttgaacatcctaagaacaggtatttttgtctctgctttgctgatgtatcctcagcaaccggaactgcctgacatctgatcctttctgtgagacaccaggctgttgaggaagaatctatggcaacattgtatctattaatatacagcttctgtatttatcaggcccagttctggtgatgatttcacttttgacagaagctgtccctcaaaagcaaacatgcaatagaagaaacagatctcaatgccatccatctgcagttgtgacaagcaaaaaagtctccagacatggccaaatgtcccctggggggcaaaatcacccccaattgagaactactgctctaaactaagcagtcttggtatcctgaagctggagcaaaatgcgacaaagtgaagaagttcctactgactgggcacacagtcaaatgcatgtcaccaagactgggggttcagtcacatgctgttcttccttgattaaaaaactcattaatctgactatcataaaggca

SEQ ID NO: 349857 - DNA, 3759 bp, Homo sapiens
aaaagttcgtgaggtgtagtcgcggcaaccaggaggtgggcgtgtggtaacgcggcgcggggacgggtggcttgaaagggtctttatgaaccctagggaaaggccgtctggtgcacccaccactagaatttgaacatcctaagaacaggtatttttgtctctgctttgctgatgtatcctcagcaaccggaactgcctgacatctgatcctttctgtgagacaccaggctgttgaggaagaatctatggcaacattgtatctattaatatacagcttctgtatttatcaggcccagttctggtgatgatttcacttttgacagaagctgtccctcaaaagcaaacatgcaatagaagaaacagatctcaatgccatccatctgcagttgtgacaagcaaaaaagtctccagacatggccaaatgtcccctggggggcaaaatcacccccaattgagaactactgctctaaactatggagtctcactctgtcacccaggatggagtacagtggcgtgatctcggctcactgcaagctccgcctcctgggttcatgccattctcctgccttagcctcccgagtagctgggactacaggcgcctgccaccacgcccggctaatttttgtatttttagtagagacagggtttcaccgcattagccaggatggtctcgatctcctgacctcgtgatccgcccgcctcagcctcccaaagtgctgggattacaggcgtgagtcactgtgcccagccaagtttagtattttttgtagagacagagtttcaccatgttggccaggctggtcttgcactcatggcctcaagtgatccacctgcctcggcctccgaaagtgccgggattacaggcgtaagccactgtgcctggccttaaatgggtaaatttcatatggtatatgaattatatttcactaaaactttaagaaaacattatacagtactgttcaaattttaagtggtccaatttaaatgcactattgtatacaattctatgtaatgtccttaccatggtatatgttaactataaatatctatgcccctacccttagtatcaaagcatatattatatgccagtgagccaagccccacatgtctgtgaaatgtggtcttctagccatagaagtagcttgtgctcctagggtattccttgaggctctgtatgaagaatgtccatttgtttgagtccctaacctacagaatattcctgaccatggaaatgtgatagataggagtaagcacatggaccaaaaggcctggaggctcatcatttaaggtacaagccaattatgtagtctttgaaagaatgctttgaaattcagcttgcttgattcaattcccaatattttcatttgtattaaaagatttggcccttacaggttaaaaacaatgtcagtgtaaccaagtgacattcaaattttggcttcccaacatgtgatatgacatcacttcatgtgaaaatagcgaagctccaaacattttctttcagtcaccttattaagctcgctgagccctgacagcctaatgaaaggctaagggggaagaaaatgtcccaacttctacactgttgaagatgggctaatgagaggttagcttgcaagaatcattctttcttggcatcctgcttctgactgcttggctttcagcttatacccagcatgaaaatttaatttcctcgcagttgaaggtagtttaaagcttattactcacatgctaaaatgttgatgtatctgtttttgtgcttgttttctggatgattggaatgctctgcagtgatgttcatatcagcagtacagcgctggacttcctagtgaagaaaacagcaagattatagacacagtttagaaacaaaggaacaccatatacatttaaaggcataaagtatttactcactccctggccacagccaccgttaccttctcaatcccaacttcggatataattattgatatatttataacgagtttatgaagaatgtgaaaaaggtataaagatttcattatttactatttcatcaatcatctacttttttctagtttttgacctagtccctgagatgtaaaacaatatctctttttgaatacatcatagtctatgggtgagaaaaatattcaaaaagatagtcaaacatgatgaatacaaaagaggcctgagaaagctctgatgggagcacagaacagaggaaggctttagacaggtgaaaaaatttacctaagtcttaaaggaagaaagggaatttctaagaagtataatctctaccatgatttgcaatatgcttacaggccttatagcctcattttataattgtgagggtgcattgactctaaagactcagtgctgaaataaccctaataacagcccaactaatggtcatatctcatatatacagtcttgacaaattatttgtgaactctagtattttaaaagttatccttctttggaaaaatagcagtagcagaaataacactcttatcctaccttggccgtggatttaaacgtcatccattagcctaatacaacgttgctgaaaagccaaatttttctacactatatgcttcaaacccaagaaagtactggagctgactaataagggaagtcattagcagtacacagctgctacaaagagcctgaacaaagtaacacaaaattatcaggagaaatgttttacacagaacagatgtagcagagtttagaagcatgcagactttttttttccacaaaggagttgcctagtaattatgcatgttttccatagtatttacattaaacataatgaaaacaatgaactggttgtcttttatattcacaaagtacttccccagggagaagtacacttcttctctagaaggaggaagttactgtactcaaagaatttaaggtataaaagcaaagaatttctgtgtgttcaaagaaacagtattcaatgactctccaattgttggacactgtaaattgaagtttccataattatagtccttcccagctgtccatttaaaaaaaaaaaaaaaagccccacaggcattaattcaatccacctttctgggaaagtgtgtttaatgacagttcttaccctttccttactcttactaaactccaatatattctgttctaacatagtttataacctatggtttggaaaacactggtttaaggagctttaaggctgccctttggctcttctctaaaatgagataataaagtgtgatcacaaatcagtctacgtaagaacatgagcaatgctagccaaacttagcacgttgggacctgccttttgaaactgccttataagctctgagccatgctcttttgaagagtttcaagggcagacaacttttgaaaatggatttgaaacaagttagtcttttgttttcgggttttgaaggtcacacctttggcatgtacttctttagggttgagttgttcaggtatcttatgctgagagattttggcttttagtaccttagtctgagatttactttgtttattgatttttttttcctgttgtatagatctgaccaccctagctatggactgaagttggagcctcttttctaatataatgcaattgaccaagactgcttgggagcagctgtcagtattgtttaaagctgtcattcaatatggccaaactctttgttatctaaaaccccttgtctgatctgttgcctctgtttcacttttccaattagatgaatgacagaaacaaaaaatcgtaataaatattgtcaaatctgattttaatagaac

SEQ ID NO: 349858 - DNA, 515 bp, Homo sapiens
gtgctgatcatcattaatgtttaatgcatacccagatggcatgacagcagccagcgtggcctttttgttgaagttaattgacataaaaagtaaataaaaccctattcttcctaacaggcccagttctggtgatgatttcacttttgacagaagctgtccctcaaaagcaaacatgcaatagaagaaacagatctcagtaagtagcttattttccttacaaacactactgaaatttcttattaatgctcctaattttcccattatgcactgcagcgtgagtatggctccagaggctgcacctaataacttccttgagctctaatgattattggtatcttttactaatgtgtatctgttctaaactacacaaaagcatacaaagccatctccctcttttaaaaacttgaaaatgtgggtatcacctttaattaaatattttaaatttctctctccaaatcagatttatctatgtgtgggagtttagatagtcccaagacttttgctaatacagtatt

SEQ ID NO: 349859 - DNA, 1630 bp, Homo sapiens
cctttgcgcgccgggttaatgggcggtaatttggtacccttgggtgcactttgttttgcccctgttcatttgaatgcaaatgggtgacccgggcccgactaggtgcttattaaattgcagttttcccccctgccttttccggaatgcagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaacagaatcattagtgcgcgttttt

SEQ ID NO: 349860 - DNA, 1934 bp, Homo sapiens
cccgggtcgaccacgcgtccgagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggaaaagccacataaatgcaaccagtgcggcaaagcgttcaaccgcagctccacgctcaacacgcatatccgcatccacgcgggctacaagcccttcgtctgcgaattttgcggcaaaggctttcaccaaaaagggaactacaagaaccacaagctgacccacagcggcgagaagcagtacaaatgtaccatctgcaacaaggccttccaccaggtctacaacctaaccttccatatgcacacccacaacgacaagaagcctttcacgtgcgccacttgcggcaaagggttttgcagaaactttgacttaaagaaacatgtgcgcaaactccacgacagcgtgggccctgctgccccctccgcaaaggacctgactaggacagtgcagagctgagagctactgccttgcccttccttccctccctgtaccacctgaaaacagatcacacatataaacttatttctaaaattaaaagaaaaaaaaactatagcagagaggctaaaatctatttatcgaaaccagcatatttttggaaagctaaatgtttcctcgatgactggcagcaaactcgtggcccccacctttgtatattcaggaaacttatttaaatccagtgcgccgaaacgtatttaattccaggcctccgcttctcctggggcagccagttttaaccccagcctgtcaccgtgagcgccccagaagagcgcggcgcccctagccatctttatacagccatgtaaatcctcctgtacaagcgaacacggaatatatacatatataactcaataaacagaatcattagtgcgcgttttt

SEQ ID NO: 349861 - DNA, 3287 bp, Homo sapiens
ggcggtggtggcggcggccggcaggcgcgggggaacacaggggccgctacgggagccgcgccgccgcccatgtcattccacttcaagtgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggtgcacccaccactagaatttgaacatcctaagaacaggtatttttgtctctgctttgctgatgtatcctcagcaaccggaactgcctgacatctgatcctttctgtgagacaccaggctgttgaggaagaatctatggcaacattgtatctattaatatacagcttctgtatttatcaggcccagttctggtgatgatttcacttttgacagaagctgtccctcaaaagcaaacatgcaatagaagaaacagatctcaatggagtctcactctgtcacccaggatggagtacagtggcgtgatctcggctcactgcaagctccgcctcctgggttcatgccattctcctgccttagcctcccgagtagctgggactacaggcgcctgccaccacgcccggctaatttttgtatttttagtagagacagggtttcaccgcattagccaggatggtctcgatctcctgacctcgtgatccgcccgcctcagcctcccaaagtgctgggattacaggcgtgagtcactgtgcccagccaagtttagtattttttgtagagacagagtttcaccatgttggccaggctggtcttgcactcatggcctcaagtgatccacctgcctcggcctccgaaagtgccgggattacaggcgtaagccactgtgcctggccttaaatgggtaaatttcatatggtatatgaattatatttcactaaaactttaagaaaacattatacagtactgttcaaattttaagtggtccaatttaaatgcactattgtatacaattctatgtaatgtccttaccatggtatatgttaactataaatatctatgcccctacccttagtatcaaagcatatattatatgccagtgagccaagccccacatgtctgtgaaatgtggtcttctagccatagaagtagcttgtgctcctagggtattccttgaggctctgtatgaagaatgtccatttgtttgagtccctaacctacagaatattcctgaccatggaaatgtgatagataggagtaagcacatggaccaaaaggcctggaggctcatcatttaaggtacaagccaattatgtagtctttgaaagaatgctttgaaattcagcttgcttgattcaattcccaatattttcatttgtattaaaagatttggcccttacaggttaaaaacaatgtcagtgtaaccaagtgacattcaaattttggcttcccaacatgtgatatgacatcacttcatgtgaaaatagcgaagctccaaacattttctttcagtcaccttattaagctcgctgagccctgacagcctaatgaaaggctaagggggaagaaaatgtcccaacttctacactgttgaagatgggctaatgagaggttagcttgcaagaatcattctttcttggcatcctgcttctgactgcttggctttcagcttatacccagcatgaaaatttaatttcctcgcagttgaaggtagtttaaagcttattactcacatgctaaaatgttgatgtatctgtttttgtgcttgttttctggatgattggaatgctctgcagtgatgttcatatcagcagtacagcgctggacttcctagtgaagaaaacagcaagattatagacacagtttagaaacaaaggaacaccatatacatttaaaggcataaagtatttactcactccctggccacagccaccgttaccttctcaatcccaacttcggatataattattgatatatttataacgagtttatgaagaatgtgaaaaagatctgaccaccctagctatggactgaagttggagcctcttttctaatataatgcaattgaccaagactgcttgggagcagctgtcagtattgtttaaagctgtcattcaatatggccaaactctttgttatctaaaaccccttgtctgatctgttgcctctgtttcacttttccaattagatgaatgacagaaacaaaaaatcgtaataaatattgtcaaatctgattttaatagaac

SEQ ID NO: 349862 - DNA, 3684 bp, Homo sapiens
aaaagttcgtgaggtgtagtcgcggcaaccaggaggtgcacccaccactagaatttgaacatcctaagaacaggtatttttgtctctgctttgctgatgtatcctcagcaaccggaactgcctgacatctgatcctttctgtgagacaccaggctgttgaggaagaatctatggcaacattgtatctattaatatacagcttctgtatttatcaggcccagttctggtgatgatttcacttttgacagaagctgtccctcaaaagcaaacatgcaatagaagaaacagatctcaatgccatccatctgcagttgtgacaagcaaaaaagtctccagacatggccaaatgtcccctggggggcaaaatcacccccaattgagaactactgctctaaactatggagtctcactctgtcacccaggatggagtacagtggcgtgatctcggctcactgcaagctccgcctcctgggttcatgccattctcctgccttagcctcccgagtagctgggactacaggcgcctgccaccacgcccggctaatttttgtatttttagtagagacagggtttcaccgcattagccaggatggtctcgatctcctgacctcgtgatccgcccgcctcagcctcccaaagtgctgggattacaggcgtgagtcactgtgcccagccaagtttagtattttttgtagagacagagtttcaccatgttggccaggctggtcttgcactcatggcctcaagtgatccacctgcctcggcctccgaaagtgccgggattacaggcgtaagccactgtgcctggccttaaatgggtaaatttcatatggtatatgaattatatttcactaaaactttaagaaaacattatacagtactgttcaaattttaagtggtccaatttaaatgcactattgtatacaattctatgtaatgtccttaccatggtatatgttaactataaatatctatgcccctacccttagtatcaaagcatatattatatgccagtgagccaagccccacatgtctgtgaaatgtggtcttctagccatagaagtagcttgtgctcctagggtattccttgaggctctgtatgaagaatgtccatttgtttgagtccctaacctacagaatattcctgaccatggaaatgtgatagataggagtaagcacatggaccaaaaggcctggaggctcatcatttaaggtacaagccaattatgtagtctttgaaagaatgctttgaaattcagcttgcttgattcaattcccaatattttcatttgtattaaaagatttggcccttacaggttaaaaacaatgtcagtgtaaccaagtgacattcaaattttggcttcccaacatgtgatatgacatcacttcatgtgaaaatagcgaagctccaaacattttctttcagtcaccttattaagctcgctgagccctgacagcctaatgaaaggctaagggggaagaaaatgtcccaacttctacactgttgaagatgggctaatgagaggttagcttgcaagaatcattctttcttggcatcctgcttctgactgcttggctttcagcttatacccagcatgaaaatttaatttcctcgcagttgaaggtagtttaaagcttattactcacatgctaaaatgttgatgtatctgtttttgtgcttgttttctggatgattggaatgctctgcagtgatgttcatatcagcagtacagcgctggacttcctagtgaagaaaacagcaagattatagacacagtttagaaacaaaggaacaccatatacatttaaaggcataaagtatttactcactccctggccacagccaccgttaccttctcaatcccaacttcggatataattattgatatatttataacgagtttatgaagaatgtgaaaaaggtataaagatttcattatttactatttcatcaatcatctacttttttctagtttttgacctagtccctgagatgtaaaacaatatctctttttgaatacatcatagtctatgggtgagaaaaatattcaaaaagatagtcaaacatgatgaatacaaaagaggcctgagaaagctctgatgggagcacagaacagaggaaggctttagacaggtgaaaaaatttacctaagtcttaaaggaagaaagggaatttctaagaagtataatctctaccatgatttgcaatatgcttacaggccttatagcctcattttataattgtgagggtgcattgactctaaagactcagtgctgaaataaccctaataacagcccaactaatggtcatatctcatatatacagtcttgacaaattatttgtgaactctagtattttaaaagttatccttctttggaaaaatagcagtagcagaaataacactcttatcctaccttggccgtggatttaaacgtcatccattagcctaatacaacgttgctgaaaagccaaatttttctacactatatgcttcaaacccaagaaagtactggagctgactaataagggaagtcattagcagtacacagctgctacaaagagcctgaacaaagtaacacaaaattatcaggagaaatgttttacacagaacagatgtagcagagtttagaagcatgcagactttttttttccacaaaggagttgcctagtaattatgcatgttttccatagtatttacattaaacataatgaaaacaatgaactggttgtcttttatattcacaaagtacttccccagggagaagtacacttcttctctagaaggaggaagttactgtactcaaagaatttaaggtataaaagcaaagaatttctgtgtgttcaaagaaacagtattcaatgactctccaattgttggacactgtaaattgaagtttccataattatagtccttcccagctgtccatttaaaaaaaaaaaaaaaagccccacaggcattaattcaatccacctttctgggaaagtgtgtttaatgacagttcttaccctttccttactcttactaaactccaatatattctgttctaacatagtttataacctatggtttggaaaacactggtttaaggagctttaaggctgccctttggctcttctctaaaatgagataataaagtgtgatcacaaatcagtctacgtaagaacatgagcaatgctagccaaacttagcacgttgggacctgccttttgaaactgccttataagctctgagccatgctcttttgaagagtttcaagggcagacaacttttgaaaatggatttgaaacaagttagtcttttgttttcgggttttgaaggtcacacctttggcatgtacttctttagggttgagttgttcaggtatcttatgctgagagattttggcttttagtaccttagtctgagatttactttgtttattgatttttttttcctgttgtatagatctgaccaccctagctatggactgaagttggagcctcttttctaatataatgcaattgaccaagactgcttgggagcagctgtcagtattgtttaaagctgtcattcaatatggccaaactctttgttatctaaaaccccttgtctgatctgttgcctctgtttcacttttccaattagatgaatgacagaaacaaaaaatcgtaataaatattgtcaaatctgattttaatagaac

SEQ ID NO: 349863 - DNA, 1936 bp, Homo sapiens
ggcggtggtggcggcggccggcaggcgcgggggaacacaggggccgctacgggagccgcgccgccgcccatgtcattccacttcaagtgacttcatgtgatgtcagctgaatgtaaaagacagtgatctcacgcggaggggaagatgtttgccatcaaaatgtgacagaagagacacgctgcatggctcggaacgcatctccttggtggtgggggaaagagacttagaggagagaggctgcgccctggcccagcctggctcggctcagctccgcgcgccatggcaagctcggcttccctggagaccatggtgcccccggcctgcccgcgcgccggagcgtcgccggccacttccaagacactggccttttccatcgagcgcatcatggccaagacgtcggagccccgtgcgccctttgagccccggcctggagcgctagaggcggacggcagccagggcaagaaactgctcaacctctgctcgccgctgccctgtatgatccccctccagcccctaggctacgaggtgccgtcaaagacactgctcagttactcggagctctggaaaagcagcctccgggcgggcggcggcggaggcggcggcggcggtggcggcggcggcggcgggggggccccagtgtgcggcgccagcggcttgtgcaaaaccaactgtggcgtgtgctgcaaggccgagctgggcctggcgccgtccgcgctgcccgcgggcagggtcatcaagccgcaggtcatcaaccaggctgtggggctgccggccagcggctcgctctactacttcaactacctggactcgaccgcgtacccgccgtctgagctcctcagcggccacctcttcccgtctggcctcctcaatgcgcaggcccccgccgccctggctgctcaccccaagctctttctgctggagaacgccaagctggccggcctggctgcggacaagttcccccacccggctccctatccccataaggagcgcttgccggcgccgctggagcaggtactgaaggaaaactcggccctgactgccgagcgcggaggcgtcaagggccacagcaagctgccaggaggctccgcagatggcaagcccaaaaacttcacctgcgaggtgtgcggcaaggtgtttaacgctcactataatctcacccgccacatgccggtccacaccggagccagaccgttcgtgtgcaaagtctgcggcaaaggctttcgccaggccagcacgctctgcaggcacaaaattatccacacccaggtgcacccaccactagaatttgaacatcctaagaacaggtatttttgtctctgctttgctgatgtatcctcagcaaccggaactgcctgacatctgatcctttctgtgagacaccaggctgttgaggaagaatctatggcaacattgtatctattaatatacagcttctgtatttatcaggcccagttctggtgatgatttcacttttgacagaagctgtccctcaaaagcaaacatgcaatagaagaaacagatctcagtaagtagcttattttccttacaaacactactgaaatttcttattaatgctcctaattttcccattatgcactgcagcgtgagtatggctccagaggctgcacctaataacttccttgagctctaatgattattggtatcttttactaatgtgtatctgttctaaactacacaaaagcatacaaagccatctccctcttttaaaaacttgaaaatgtgggtatcacctttaattaaatattttaaatttctctctccaaatcagatttatctatgtgtgggagtttagatagtcccaagacttttgctaatacagtatttccaatttaatcttaagtagaaaaatgtatgtaattaagagatttattataaaacatttggcaaagaaggaaagaaaacagtaactatgtag

SEQ ID NO: 349864 - DNA, 162 bp, Homo sapiens
gtaaataggttcatcactgtgaagatttctggacattctgccaccaccttggtctacaagtggcattcccaaagcctgaagctatctttggcacctgtaaaacgccagcctttccctccatgcctacccaaagtggtaggtccagagatgtcttgatcatct

SEQ ID NO: 349865 - DNA, 433 bp, Homo sapiens
gcagactggagctggctgtggattttatttctcaggagaaggaggtgggagctggagagagtgacccgtgcatctttccagcttttccttggccacctgggtggcatgggagctgggagtcagagttctgctgagctgtaggaccaaaggccactggctccgctgcacctgcggactgagacacccacctgctgagtgagacccagcctctgcgtgcttaggggtcccctgctacagggcattgaggtgaggtccgcctttgcccagtgtgagagcgctgctttcagagctttgagaaggctgttatcatttgtttctttttgaacttgccacctccccacttagagaatatttctggggacagagtttcgtaactcctgccgcatagttggtgcctgctctcgactacattaaatctattttcagtgcccct

SEQ ID NO: 349866 - DNA, 343 bp, Homo sapiens
taggttatgggcacgccacgtgtggtcctttcccagctgtcagtgttctcccggctgaaatagactttagcatttttggatgcagcacaacttcctagcctggaaaagccatattctcaacaattattgtgtaaatttaagaggtacagttgtaataataacccttgtccctatgcctcctacctttgcacagccatttctttggcctagaatgtccttctctgccttgactccagagcatgcttcttcctgagacttatatcttactgcagctgagctgaccctatcttcttacagtccccttcaatttgagagtttttttttttttttttttttttttttt

SEQ ID NO: 349867 - DNA, 294 bp, Homo sapiens
ctctggcagagtaaatgttctctacttttgagtcagaccagtgaaggccaaccttcgtcttaggaagaagttgtggtgccaacataagctttggagccaaacagacttagttcaactaccagcctttacctagtttttggtgctcccattgactagtctgcggcaacagatgagttaaaggagatgttgggtgtgtatcctaacacactgcacaggctgtgttgcagaatagtcagtaaatgtccattttctttcttcacatacaccttcttctttctgcaccaataatttaag

SEQ ID NO: 349868 - DNA, 2277 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349869 - DNA, 2636 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaaggtggggctcggtgaccccgtgatggtcagggtcaccaggaacacttgtcctcacccaggagctgattcctgagcgctgatgaaatgggtgggaaggctggtgaggagagggcagcccaggccaggcccagctcagcagccctgaaagtgtggggcctgggagcctcccaccagtcatggcctggctggtcactcattcacgctacatttattgggtagctgcaggctagaggtggagggcaactcagcagggtccctgccttctggaaccttctgggccagaagcaagtcaggtggagggtgtggccgcagggccaggcaggcaggggctctatgctttgtctccacctgtccctgtagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349870 - DNA, 2608 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaaggtggggctcggtgaccccgtgatggtcagggtcaccaggaacacttgtcctcacccaggagctgattcctgagcgctgatgaaatgggtgggaaggctggtgaggagagggcagcccaggccaggcccagctcagcagccctgaaagtgtggggcctgggagcctcccaccagtcatggcctggctggtcactcattcacgctacatttattgggtagctgcaggctagaggtggagggcaactcagcagggtccctgccttctggaaccttctgggccagaagcaagtcaggtggagggtgtggccgcagggccaggcaggcaggggctctatgctttgtctccacctgtccctgtagggtgctccctgaaggttctggcggacagcgagcgatatacgtggatcgtgctgtgagggccaggccgccccggacactgactccaactacctccgtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349871 - DNA, 2352 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccaggtgaggcagggctggggggcagggtcagggcgcggccaaggcgacgagagccactcaccccctggccccgcagcgcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349872 - DNA, 2451 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349873 - DNA, 1193 bp, Homo sapiens
ttgggcatgggcctggcccctcgtgcatttgcccttttctcggctacagctgtggacagccccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349874 - DNA, 1054 bp, Homo sapiens
cccccacttcctgcctccccagagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349875 - DNA, 2556 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagagcccctgccgctggctttgggcttcctccgcctgatgttcctctccctgcccaagccccgaccacacatgagctgggagttccagtacctgggtgggcctccccattgaaagtgtgggagctccctggatagggctgagtcttcccccgcagagtgagagttaccgaagcaggctctgtctcctccatcagactggaaactcccagagctgggggatgatgtctctctcccccatcagtttgggagctctggagggcagaaatgtggatctcttgcagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349876 - DNA, 2569 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccggtgagcgcggggatcctgccctctctgtccactaggggggccactggcagacacttcacggtgggggtgtggggacgtgagaaggctctccctgtgccacaacctggctgggcccctccatagctgttccaaagacaaaaggccctcagggtagcctggggcctggttcaggagcccggctgtcccagcgtttgtcctatgtccctctccactgtagaccaaagacctatcacaccagcctcaaggtggcatgggacctcaacacagggatcttcgagacagtcagtgtaggcgacctgactgaggtcaaagggcagaccaggtgaggcagggctggggggcagggtcagggcgcggccaaggcgacgagagccactcaccccctggccccgcagcgcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349877 - DNA, 2494 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccggtgagcgcggggatcctgccctctctgtccactaggggggccactggcagacacttcacggtgggggtgtggggacgtgagaaggctctccctgtgccacaacctggctgggcccctccatagctgttccaaagacaaaaggccctcagggtagcctggggcctggttcaggagcccggctgtcccagcgtttgtcctatgtccctctccactgtagaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349878 - DNA, 2039 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagccctgcccgcccccagcctccccacccaggccggcaacctggccatccccattccgttcttcttcatgtaataaatgttttaatttctga

SEQ ID NO: 349879 - DNA, 1884 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatggtgagcggggggcaggcatcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctga

SEQ ID NO: 349880 - DNA, 963 bp, Homo sapiens
agcggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagagcccctgccgctggctttgggcttcctccgcctgatgttcctctccctgcccaagccccgaccacacatgagctgggagttccagtacctgggtgggcctccccattgaaagtgtgggagctccctggatagggctgagtcttcccccgcagagtgagagttaccgaagcaggctctgtctcctccatcagactggaaactcccagagctgggggatgatgtctctctcccccatcagtttgggagctctggagggcagaaatgtggatctcttgcagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtagggaggcttcaacaccaggctggcccttcagatggtgtggttcagcaggtcacagcaacctctgagcctcaggttccttgggtgtaaaatgatcatcatgtactcctggggtcatcatcaagattccatgtgttagatccaaccatatgaaattaccagggcctggcatggtagctcacacctgtaatcccagcactttgggaggccaaggcgggaggatcacttggtccgagtagttcaagaccaggctgggcaacatggcaaaaccctgtctctactaaaaataaaa

SEQ ID NO: 349881 - DNA, 800 bp, Homo sapiens
tctcgaaaaggcactctgtcacgtgtacacaggaaagggccctgacaagaggatgggactgcagttgtggctgccagagtcttgctttgtcgcccagttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcaagcccgaatgatatctcctattcgctacacaattctccgatccgtccctaaacaaactaggaggcgtcctttgccctattatatccatcctcatcctagcaataatccccatcctccatatattccaaaaaacaaagcataaatatttcgcccactaagccactcactttatgactcctagcgagactcctattctagctgcatcgcaggacacagtaagtaccctttacatcatggacagtcgctccgtctatacttcaaaatctatc

SEQ ID NO: 349882 - DNA, 473 bp, Homo sapiens
gacaggttaactgatgttttttaaaattgtcttttatttctggaaagatctgacttattcctagcttttttcataccctttattattagtgccttaaaataaagctggccaggtgcagtgccacacacctgtaatacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgaaaaataaa

SEQ ID NO: 349883 - DNA, 309 bp, Homo sapiens
acaaaacaaagtatattagggattcccaggggctggggctggggctggggttggttggggggaagaaatggggagtcattgctaaggggtacaagtttctctggggtaacgaaaatgttatagaattagatagtgttgatggctgcacaacctgtggatacactaaaataaataaataataaatagttacttgattacagttacttagcctttattttgtttgtttgttttttgacagagtcttgctttgtcgcccaagatcgagccattgcactccagcctgggcaataagagtaaaactccatatcg

SEQ ID NO: 349884 - DNA, 2548 bp, Homo sapiens
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcacacactggggcctgtcgtggggtgtggggagggaggagggatagcattaggagatatacctaatgtaaatgatgagttaatgggtgcagcacaccaacatggcacatgtatacctatgtaacaaacctgcacattgtgtacatgtaccctagaacttaaagtataattaaaaaacaaaacaaaacaaaacaaaaacaatgaggtgctattgttttagtggtgagtatccggagacctgggagttctatttaccaggtataacctgggctcaaaattccaggctgacttcaggcatgtcctcatctcatagatgccagcactaaggcccagagagggcgagctcattcagcccacccatcttctcacccctgactgcatttcccgggggtccttctgcagccaggtgctgctgtggtactttgggatctattggctgagctcccagagaagggtcatggattgggctagtttggaacaagtgaagggactgaagatgggctcagtatggggcgaagaccttcaggaagggtctgcagagtgagtaggggggttttgactaggaaaagttccaaccctgccggggccgctgtcaagagaaaagcatctattacagttacatttttaagttaagtagactgaagaatatttcttgtgtattaaagacgttcctttttggttgatttgcaatggaaaagctttgttttcttttttttttggaaacagggtctcactctgctcactctgtctcccaagctggagtgcagtggtacagtcacggctcactgcagcctccacttcctggactcaagtgatcttctcacttcagccttctgagtagctgggactacaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgaaaaataaa

SEQ ID NO: 349885 - DNA, 2720 bp, Homo sapiens
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcacacactggggcctgtcgtggggtgtggggagggaggagggatagcattaggagatatacctaatgtaaatgatgagttaatgggtgcagcacaccaacatggcacatgtatacctatgtaacaaacctgcacattgtgtacatgtaccctagaacttaaagtataattaaaaaacaaaacaaaacaaaacaaaaacaatgaggtgctattgttttagtggtgagtatccggagacctgggagttctatttaccaggtataacctgggctcaaaattccaggctgacttcaggcatgtcctcatctcatagatgccagcactaaggcccagagagggcgagctcattcagcccacccatcttctcacccctgactgcatttcccgggggtccttctgcagccaggtgctgctgtggtactttgggatctattggctgagctcccagagaagggtcatggattgggctagtttggaacaagtgaagggactgaagatgggctcagtatggggcgaagaccttcaggaagggtctgcagagtgagtaggggggttttgactaggaaaagttccaaccctgccggggccgctgtcaagagaaaagcatctattacagttacatttttaagttaagtagactgaagaatatttcttgtgtattaaagacgttcctttttggttgatttgcaatggaaaagctttgttttcttttttttttggaaacagggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatctgggtgtgattcagagagctgtttatgcaaaaccagccttgtcaccatcaggcaaggcacctgaattcccaccgcagagagtgctgtggccctgaggacttttctgtcaccagccatttccaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgaaaaataaa

SEQ ID NO: 349886 - DNA, 2567 bp, Homo sapiens
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataagagtcttgctttgtcgcccagttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcacacactggggcctgtcgtggggtgtggggagggaggagggatagcattaggagatatacctaatgtaaatgatgagttaatgggtgcagcacaccaacatggcacatgtatacctatgtaacaaacctgcacattgtgtacatgtaccctagaacttaaagtataattaaaaaacaaaacaaaacaaaacaaaaacaatgaggtgctattgttttagtggtgagtatccggagacctgggagttctatttaccaggtataacctgggctcaaaattccaggctgacttcaggcatgtcctcatctcatagatgccagcactaaggcccagagagggcgagctcattcagcccacccatcttctcacccctgactgcatttcccgggggtccttctgcagccaggtgctgctgtggtactttgggatctattggctgagctcccagagaagggtcatggattgggctagtttggaacaagtgaagggactgaagatgggctcagtatggggcgaagaccttcaggaagggtctgcagagtgagtaggggggttttgactaggaaaagttccaaccctgccggggccgctgtcaagagaaaagcatctattacagttacatttttaagttaagtagactgaagaatatttcttgtgtattaaagacgttcctttttggttgatttgcaatggaaaagctttgttttcttttttttttggaaacagggtctcactctgctcactctgtctcccaagctggagtgcagtggtacagtcacggctcactgcagcctccacttcctggactcaagtgatcttctcacttcagccttctgagtagctgggactacaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgaaaaataaa

SEQ ID NO: 349887 - DNA, 2684 bp, Homo sapiens
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcacacactggggcctgtcgtggggtgtggggagggaggagggatagcattaggagatatacctaatgtaaatgatgagttaatgggtgcagcacaccaacatggcacatgtatacctatgtaacaaacctgcacattgtgtacatgtaccctagaacttaaagtataattaaaaaacaaaacaaaacaaaacaaaaacaatgaggtgctattgttttagtggtgagtatccggagacctgggagttctatttaccaggtataacctgggctcaaaattccaggctgacttcaggcatgtcctcatctcatagatgccagcactaaggcccagagagggcgagctcattcagcccacccatcttctcacccctgactgcatttcccgggggtccttctgcagccaggtgctgctgtggtactttgggatctattggctgagctcccagagaagggtcatggattgggctagtttggaacaagtgaagggactgaagatgggctcagtatggggcgaagaccttcaggaagggtctgcagagtgagtaggggggttttgactaggaaaagttccaaccctgccggggccgctgtcaagagaaaagcatctattacagttacatttttaagttaagtagactgaagaatatttcttgtgtattaaagacgttcctttttggttgatttgcaatggaaaagctttgttttcttttttttttggaaacagggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatctgggtgtgattcagagagctgtttatgcaaaaccagccttgtcaccatcaggcaaggcacctgaattcccaccgcagagagtgctgtggccctgaggacttttctgtcaccagccatttccaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatcccca

SEQ ID NO: 349888 - DNA, 1996 bp, Homo sapiens
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcacacactggggcctgtcgtggggtgtggggagggaggagggatagcattaggagatatacctaatgtaaatgatgagttaatgggtgcagcacaccaacatggcacatgtatacctatgtaacaaacctgcacattgtgtacatgtaccctagaacttaaagtataattaaaaaacaaaacaaaacaaaacaaaaacaatgaggtgctattgttttagtggtgagtatccggagacctgggagttctatttaccaggtataacctgggctcaaaattccaggctgacttcaggcatgtcctcatctcatagatgccagcactaaggcccagagagggcgagctcattcagcccacccatcttctcacccctgactgcatttcccgggggtccttctgcagccaggtgctgctgtggtactttgggatctattggctgagctcccagagaagggtcatggattgggctagtttggaacaagtgaagggactgaagatgggctcagtatggggcgaagaccttcaggaagggtctgcagagtgagtaggggggttttgactaggaaaagttccaaccctgccggggccgctgtcaagagaaaagcatctattacagttacatttttaagttaagtagactgaagaatatttcttgtgtattaaagacgttcctttttggttgatttgcaatggaaaagctttgttttcttttttttttggaaacagggtctcactctgctcactctgtctcccaagctggagtgcagtggtacagtcacggctcactgcagcctccacttcctggactcaagtgatcttctcacttcagccttctgagtagctgggactacaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgaaaaataaa

SEQ ID NO: 349889 - DNA, 1927 bp, Homo sapiens
tctcgaaaaggcactctgtcacgtgtacacaggaaagggccctgacaagaggatgggactgcagttgtggctgccagagtcttgctttgtcgcccagttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcacacactggggcctgtcgtggggtgtggggagggaggagggatagcattaggagatatacctaatgtaaatgatgagttaatgggtgcagcacaccaacatggcacatgtatacctatgtaacaaacctgcacattgtgtacatgtaccctagaacttaaagtataattaaaaaacaaaacaaaacaaaacaaaaacaatgaggtgctattgttttagtggtgagtatccggagacctgggagttctatttaccaggtataacctgggctcaaaattccaggctgacttcaggcatgtcctcatctcatagatgccagcactaaggcccagagagggcgagctcattcagcccacccatcttctcacccctgactgcatttcccgggggtccttctgcagccaggtgctgctgtggtactttgggatctattggctgagctcccagagaagggtcatggattgggctagtttggaacaagtgaagggactgaagatgggctcagtatggggcgaagaccttcaggaagggtctgcagagtgagtaggggggttttgactaggaaaagttccaaccctgccggggccgctgtcaagagaaaagcatctattacagttacatttttaagttaagtagactgaagaatatttcttgtgtattaaagacgttcctttttggttgatttgcaatggaaaagctttgttttcttttttttttggaaacagggtctcactctgctcactctgtctcccaagctggagtgcagtggtacagtcacggctcactgcagcctccacttcctggactcaagtgatcttctcacttcagccttctgagtagctgggactacaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgaaaaataaa

SEQ ID NO: 349890 - DNA, 2088 bp, Homo sapiens
acaaaacaaagtatattagggattcccaggggctggggctggggctggggttggttggggggaagaaatggggagtcattgctaaggggtacaagtttctctggggtaacgaaaatgttatagaattagatagtgttgatggctgcacaacctgtggatacactaaaataaataaataataaatagttacttgattacagttacttagcctttattttgtttgtttgttttttgacagagtcttgctttgtcgcccagttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcacacactggggcctgtcgtggggtgtggggagggaggagggatagcattaggagatatacctaatgtaaatgatgagttaatgggtgcagcacaccaacatggcacatgtatacctatgtaacaaacctgcacattgtgtacatgtaccctagaacttaaagtataattaaaaaacaaaacaaaacaaaacaaaaacaatgaggtgctattgttttagtggtgagtatccggagacctgggagttctatttaccaggtataacctgggctcaaaattccaggctgacttcaggcatgtcctcatctcatagatgccagcactaaggcccagagagggcgagctcattcagcccacccatcttctcacccctgactgcatttcccgggggtccttctgcagccaggtgctgctgtggtactttgggatctattggctgagctcccagagaagggtcatggattgggctagtttggaacaagtgaagggactgaagatgggctcagtatggggcgaagaccttcaggaagggtctgcagagtgagtaggggggttttgactaggaaaagttccaaccctgccggggccgctgtcaagagaaaagcatctattacagttacatttttaagttaagtagactgaagaatatttcttgtgtattaaagacgttcctttttggttgatttgcaatggaaaagctttgttttcttttttttttggaaacagggtctcactctgctcactctgtctcccaagctggagtgcagtggtacagtcacggctcactgcagcctccacttcctggactcaagtgatcttctcacttcagccttctgagtagctgggactacaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgaaaaataaa

SEQ ID NO: 349891 - DNA, 1738 bp, Homo sapiens
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatctgggtgtgattcagagagctgtttatgcaaaaccagccttgtcaccatcaggcaaggcacctgaattcccaccgcagagagtgctgtggccctgaggacttttctgtcaccagccatttccaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatcccca

SEQ ID NO: 349892 - DNA, 1828 bp, Homo sapiens
tagtcccagctactcgggaggctgaggcaggagaatggcatgaacccgggaggcggagcttgcagtgagctgagattgtgccactgcactccagcctgggcgacagagtgagactccgtctccaaaaaaaaaaaaaaaaaaaaaaaaaaaaaactcgagactagttctctcctcgtgccgaattcggcacgaggtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaacaggaaggggaacatcacacactggggcctgtcgtggggtgtggggagggaggagggatagcattaggagatatacctaatgtaaatgatgagttaatgggtgcagcacaccaacatggcacatgtatacctatgtaacaaacctgcacattgtgtacatgtaccctagaacttaaagtataattaaaaaacaaaacaaaacaaaacaaaaacaatgaggtgctattgttttagtggtgagtatccggagacctgggagttctatttaccaggtataacctgggctcaaaattccaggctgacttcaggcatgtcctcatctcatagatgccagcactaaggcccagagagggcgagctcattcagcccacccatcttctcacccctgactgcatttcccgggggtccttctgcagccaggtgctgctgtggtactttgggatctattggctgagctcccagagaagggtcatggattgggctagtttggaacaagtgaagggactgaagatgggctcagtatggggcgaagaccttcaggaagggtctgcagagtgagtaggggggttttgactaggaaaagttccaaccctgccggggccgctgtcaagagaaaagcatctattacagttacatttttaagttaagtagactgaagaatatttcttgtgtattaaagacgttcctttttggttgatttgcaatggaaaagctttgttttcttttttttttggaaacagggtctcactctgctcactctgtctcccaagctggagtgcagtggtacagtcacggctcactgcagcctccacttcctggactcaagtgatcttctcacttcagccttctgagtagctgggactacaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgaaaaataaa

SEQ ID NO: 349893 - DNA, 1209 bp, Homo sapiens
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatctgggtgtgattcagagagctgtttatgcaaaaccagccttgtcaccatcaggcaaggcacctgaattcccaccgcagagagtgctgtggccctgaggacttttctgtcaccagccatttccaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatcccca

SEQ ID NO: 349894 - DNA, 1186 bp, Homo sapiens
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatctgggtgtgattcagagagctgtttatgcaaaaccagccttgtcaccatcaggcaaggcacctgaattcccaccgcagagagtgctgtggccctgaggacttttctgtcaccagccatttccaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatcccca

SEQ ID NO: 349895 - DNA, 1036 bp, Homo sapiens
  misc_feature (944)..(944): n is a, c, g, or t
  misc_feature (954)..(954): n is a, c, g, or t
  misc_feature (956)..(956): n is a, c, g, or t
  misc_feature (972)..(972): n is a, c, g, or t
  misc_feature (974)..(974): n is a, c, g, or t
  misc_feature (984)..(985): n is a, c, g, or t
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattggtctcctctgctcntctgtctccngnctgagtgcgggtcagncncggtcactgnnctcccttctggactcatgacctctccttcgctctgttccggacacggtgcc

SEQ ID NO: 349896 - DNA, 915 bp, Homo sapiens
  misc_feature (878)..(878): n is a, c, g, or t
  misc_feature (880)..(880): n is a, c, g, or t
tctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataagagtcttgctttgtcgcccagttggagtgcagtggcacgatctcggctcagtgcaacctccgcctcctgagttcaagtgattctcctgcctcagcctccctagtagctgggattacaggacaagaaaggacaatcttctgatctatgcctggactgtatatntnttagtgtctaattgtctggtcagatgacttgtagc

SEQ ID NO: 349897 - DNA, 382 bp, Homo sapiens
tgggctgggctcgctggcggctggtttgagaggagggtgattcagaggaaggcagtgacacccagatgtgggacaggctgcaagaaagcctggtgggccttagggcagacacttgtggggacccggggagccctaggtgccctgacaggtggaagaggggtgcagaaagggaggatgtcaaagagagaatgtcaaaggtcataaccaaacctaacaattttcttctacttatgccttttgtcaggacaaggagagggacaaattccttcttggcatccttatggccctgtgacctgctaatgaatgctgactctgagttgctactagaatttggtttccttgtggcttcccaggaattgtgagccatgttggataaggacct

SEQ ID NO: 349898 - DNA, 776 bp, Homo sapiens
tgcagttggcggataattgcagctttctttcattccctacatgagttcaaatggcagcaaacaaactaggagaacgcagaccttctgacttcctgagggtccagaatccagactgaggctcttgcttcatgccagtgcccctctgcacattttccatacaaactcctaaatcccatccggttccttcgccaacatccacttcaaagtaacgtcttcctgaggtgaagccttcacaacccaagacacaggggaaggcagtaaatctcctggaagatgtgtcctgattctcctgggtgtatccacgagtcacttgtctccgatcctcagagagaattagttcgtgatgagctgtatctggatccagagtcacactaactgcaaaacaaaacaaaacaaacaaaaataattttgttgctgtgaagaacacaggttattttattttattttattttgagatggagtgttgctgtcacccaggctggagtgcactggcactatctcaactcactgcaacctccacctcctggattcaggcaattctcctgcctcagcctccggagtaactgcgactacaggtgcgcaccaccacaagtggctaatttttttaaattttctgtagagatggggtttcgccatgttggccaggctggtctcaaactcctgacctgaagtgttccacccacctcggcctcccaaagtgctggattacacaggtgtgagccaccatgcccagccacaagttattttcaataaaaccagcctgtgttcaaacccaa

SEQ ID NO: 349899 - DNA, 377 bp, Homo sapiens
ttttttaattctaaattttgctgtgtttttgacaagtaaaagtaaacaataatacttagataaagttatcatagttttaaaaatatctttaaatccaaaaataatagagattcacaaataaattgaatgttaatattagaagaatttctaacactattcacttagacaggattaaacaactattcacaacacacctacacaacaaatacacaagttataacaaaaatacatggataggctgggtgcagtggctcatgtctgtaatccaagcactttgggaggaaggcggatcacgagatcaggagttcgagaccagcctgaccaacatggagaaaccccatctctactaaaaatacaaaattagccaggcgtcgtgc

SEQ ID NO: 349900 - DNA, 98 bp, Homo sapiens
agggtaagttatttctatataataatattaacttctgatttgtaggagtggctgtaattttgaattattaatttagtgttcttccatagtgtcagttt

SEQ ID NO: 349901 - DNA, 413 bp, Homo sapiens
acagatttctttattatgaggttatgttttccctcttggcacccagtaagtactttgtaagttgatactttggcattgtaagaatatccagttcattatgaccttccacctcttggctcagtctgctcaaaagttattattgagggccaggcacagtggctcacacctataatcccagtactttgggaggccgaggtaggcagatcacttgaggccaggaattcaagaccagcctgggcaacgtggtgaaatcctgactgtatagaaaaaaaaaagaccaaaaattagccaggtatggtggtgtacacctttagttccagctactcaagatactaagttgggagaatcacttgagaagtctaggatgcagtgaactgtgattgcgtcactgtacttcagccttggcaatagag

SEQ ID NO: 349902 - DNA, 982 bp, Homo sapiens
tataaaggctcaggcatatgtaaggcacagagggagtgacggccaacctgggaattagactaaggtttctttcctctctgtgccttgatagagaatccacctcagttccagaacttgcatcagaaacagggtcctcttcccacaccccacttctcggggagggctcaagccgcatctgcctctggaagcagatatccgtgactattatgactccttggaaggcagccaggcatgagcctgtggcttacattccttaatgctcaagcacattccttcgtgttcaagtatacgtgtggttggctcgagcacagaagcacagagctgagcaaaatattcagcgcctttttcagagaaccctggctggtgctggtggatgttcctgccccttcctccaccatgaacatttttaaaaattaagggagaaacaggaaaactttgaagaatcttccagatttgcctaacgcagatgtgcatgacctgacaagatagatgtgccatttggaccctttcaagagcagacagaatggaagggaggctggagtgcaatggtgtgatctctgctcctgcaacctgcgcctcctgagttcaagcgattctcctgcctcagcctcccaagttgctgggattacaggggcccgccaccacgcccagctaattttgttattttcagtagagatggggtttcatcatgttggccaggctagtcttgaactcctgacctcaggcgatccgcccgcctcggctcccaaagtgctgggattacaggtgtgagccactgcacctgcccaaggactaaggttttctatttcttattgtgtcagttaggttgtatttttctgtgaatctgttcatttcaccaaattttcaagtttgttggcttaaagttttcgataatatactcttatttgtggtgaagtcccttttttatttcttgtatttgttatttgtgccttcttttcttttttttttttccttttctttt

SEQ ID NO: 349903 - DNA, 619 bp, Homo sapiens
cctcccaaaatgctgggattacaggcatgaactgctgtacccggcctggttgttgcattttaatgtactgagccaagcaccaggctccagggacactgctactaggtggcctgtccttggctctgatgcaggcgcttccaggaagaatgggctgcagctctgtgcagcctgcctgtgctgggccaatgtcagctccccttgctcgaacaggattggccagaacacgccctgtgcctgcgagcagccttgaatgccactggggatttgaggtttaggcgtcccgttccttgagcaggaacctctgcagaaaggcaattagaagaacaaagtgccctctccctgacggtctgtctccctcacaccaaaaaggaaggtgaagcttcctttttaaggagacccctttttaagaaccatgcacctgcccaaggactaaggttttctatttcttattgtgtcagttaggttgtatttttctgtgaatctgttcatttcaccaaattttcaagtttgttggcttaaagttttcgataatatactcttatttgtggtgaagtcccttttttatttcttgtatttgttatttgtgccttcttttcttttttttttttccttttctttt

SEQ ID NO: 349904 - DNA, 463 bp, Homo sapiens
tccttggaaggcagccaggcatgagcctgtggcttacattccttaatgctcaagcacattccttcgtgttcaagtatacgtgtggttggctcgagcacagaagcacagagctgagcaaaatattcagcgcctttttcagagaaccctggctggtgctggtggatgttcctgccccttcctccaccatgaacatttttaaaaattaaggtgagtctgggcacagtagctcatgcctgtaatcccagcactttaggaggctgagatgggaagatcccttgagcccagaagtttgagaccagcctgggcaacacagtgagaccccatctctacaaaaactaaaaaattagccaggcagggcatcgtgtgcctgtagccccagctactcagcagtctgaggtaggaggatcacttgagcccaggaagttgaggcttcagtgagccatgtttgtgacgctgcactcca

SEQ ID NO: 349905 - DNA, 9570 bp, Homo sapiens
  misc_feature (3767)..(3767): n is a, c, g, or t
  misc_feature (5593)..(5593): n is a, c, g, or t
  misc_feature (8473)..(8473): n is a, c, g, or t
cacaggtggacctgtttaagcgccgcgtggtgcggagactggcatccctcaagacacggcgctgccggctgaacagggcagcgcagggcctcccagatccgggtactgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctggggaaccgctactccgatgattagctgcccagctggactctgcacatggggatggacccttcctgcctgcaccccggtcctcagcctgggctcccaggacaggacaggatgggacagcaggatagacaggacagcaagcccagtgggtgggaggaaggatgagggccccaccatgtccacactgggaaggagggccccacagcttcagactgaggatctagggctgggacctgtcagtcaaggaagagaggtcactttgggaccttctctgcaatcctgtgacgtgagtctgccctccttacaggcagctcccaggtcaataaggaaagagaatatggggccagtgtagctgtcgccagggttctgggagctccctgtggcctgtctgggaattcctgggggctgagactacagtggccaggttttgtgcttatttattggggggtgggttgagggaagagctatctggccttggggtaccctggcctgaccgtctttcaggatacttcttgtcaaggctgtctgcctgttgcctttggtcctcaagcactgggagccatgggtcccactgcctgtccagcctggctcccttcctgggcctggctaggaccaaaggttttagaaaccgtcctgttctggaatccttggctgcggctttgtgttgctgaccgggatactcgaaaccccaggatcaatgtggtgcctcatccaggggcatcctttttttttttttttttttttttaaagagttggagtagggaaggtttaatagtaaaataaacgtggctatattttaacataagatgtaaaatgtgtataggtgttttaagattttaaaaagttaccttaggttctactgcctgtggtagatggaattctaagatggcccccaaggtctcccactaccacctgccgtgaacatgccttgcattaatataatttctggaactgggactcagagggattttatttatttattttatttttatttcttgagatggagtttcactcttgttgcccaggctggagtgcaatggcgtgatctcgcctcactgcaacctccgcctcccgggttcaagcaattctcctgtctcagcctcccaagtagctgggattacagacatgcgccaccacgcccggctaattttgtatttttagtagagacggggtttctccatgttggtcaggctggtctcgaactcccgatctcaggtgatccgcctgcctcggcctcccaaagtgctgggattacagacgtgagccactgcgcctggcttctcaaagggattttatgcccatggttgggttctgtcttatagcaagctgacctgaagatagggaaagtatttgagtgtgagccttgccctaaccacatgagcctattcaaagtagttttctgctggtagaagaggaggaagtcagggatttgaagcatgtgggggattcagcacatgagaaatcctctgttgttgacttgaagatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttggtgggcgcctgagagagctactcagctgtgaggtccttcccctggacttgagcacaggccttctggctcagggtgctgagggatggtgctcccctgtgaggggggtgcccggggcaccccagcctccctcaggaactcccaggcccctcagaagcaggaagttgggctgaccaaagctgtggtagctcagctatatacatggcccctcttgacccttctctgtgaactgaggtgctctacctgacggcctcttcaccaagggaaaatgcttcaggcatttgggagcgtgcgccctgagaaggcctcagcaagtttttggagattgtccttcacagaaacggggtcccattatattgtccaggctggtctcaaactcctgggctcgagtgatctgcccgcctcagcctctcaaattgttgggattacaggcatgagccgccgcacccggcctgacgaggcttcttgctgcacttaaaggaatgacagctatagagggcatatgggactggaaggcatcggatccataacatcctcacgccttctggaaatgtgaaaaatgtttcacaaaagcacagcctaaggcctcatgtgatgaggtgggctctccacaagttcccggggcagagtctgaagacctgctgctggataggggcttcctcctggtccccaagggcccgccctctcaggcccaccttgaggccaccctgctgggccacttcccggattttggacagcattgattggagccgcccgttctcctcctgtaggacccggatgcggatgtcgttggcctgcacttgcctctccatgtgatctgtgacgttgccagagtctgtgggacatgttatctgggattccacgctgctggatctgcctcctgtgcccaatgggacaggaccttagaagggaggcacaccagcttgggcaggtggcctggaggcacaaaggagctgtgtagtgcaccaggcctcctagctcatcttccttctcccgaggccttattcccccttccctgtcccccaacctgcagggaagatgaccatagtattataaaatctgagagctgggtgggacctagagctctcaaaagacttagcaaggccgggcgcggtggctcacgcctgtaatcccagcactttgggaggcccaggtcaggggatcattaagtcaagagatcaagaccatcctggccaacatggtgaaaccccgtctctactaaaaatagaaaaatgagctgggtgtggtggcgggcccccgtagtcccagctactcaggaggctgaggcaggagaatcacttgaacccaggaggtggaggttgcagtgagcagagattgtgccactgcactccagcctggcaacagagtgagactctgtctcaaaaaaaaaaaaaaaaaaaaagacttagcaaataagcatgagaggagagtgaatctctgacaaggccccccgttttggacaggctacagccaaagtgagctgtccaaggtcacacggccagctcaagcttgggaacggcaggaattccgccaggctgctcttcccctgcttttgtgatggatgcttccttctggctccaggagcccgggagaattgctgccccttctggttcagtttcctgctatgggaaatagctatggggctatgacctgcctcacaaggtggttgagaaggggacagaagggcctggatgatgtctcacgagcagctaactgcacatcttcctgccagctctgcaaanggatttgccctagtgctttaggggtctggaggggctgggagaacccaggtcacctgatatccaatcctgtgccaagatgggtacctagcactcctatgccatggggtccaggacagtgggcagctggaggctgtgtccttgggactagtcccatggtgtggtttggggacccattccaagaaccaagaagggggacacacagaagtcgagcaagaattagcatgtgacgtagtgaagagcacaggctgtggggacaaccagacctgtgtctgcgtttggctgttgtgactagaggcagtcacatcactgttgggctttcacgtccctgtctatgcagagtggatgacgcatgaagcacttgcgtgctgtggtgggtccacaggggctgcgctgctggccgcctggctttaacacccttgctgcaggctagggagctgcagtccccagtgtcctgcccacacgagccctcagctgctggccctgagccccagcatgcccttggcaccatccccagtcccctaccatggatctgggtctcggtgggcctgtgcaggtctgggaaggccaccagcagccgctcccgctccttcagctcctccagctcccgttctagctccaggatggttagccgcaggtccgtagtcgcctgctccaggccttgcttctccctctgcaggctctgcagcagctcctgggacagacggaggctcaggcctggctcctgagtgagctacatggtactcagcgccctggggcaccgtccctacccaagaaaagacatgggacaggcctgcaggcactcagttggccggagacttctctggcaaaaaggaagacccccaccctcacctgctgggccctgagctggcattgcccctgctcccgctcgctctgcagctgctcctccacgcgggcccgctgggcctcagcctcgtccaggctgccccgcagctcctcacgttcctggtccaggctgtccagctgctttagcagggctcgctgcttggcctgcagagactaagcaggaacggacaagcagggaggctgtgagacccacagggctaggcccagccatgtggaactaaggaggctacagcatctactacccctcggctgctacccccctggggtgtgtgtctgtgtctagggaatgctggtcacatgcgtggaagggtaggggtcgggggaagctggcagcaggcagatgcacaccggacctggtcaaggccaggatcccagcttgaagaccccggcccttggaacgcagatggctggctctgggggtctcacccccacttccttccagtcatacacagaccccacttggagaggaattctgggaactaagtttttcttctcctcgggtctccagtgtcacatcatcccatgttgctgaagcccacatttcctaacacccactgaatggaaagcaggaagaactaacgctggactgctcggagtcctggctccacctctcactagctgtgtggccttgggcaacttccttaacctcactcaataaggctgtttcctcattcgtaaaatgggggtgacaagagtatctacctcctgttgctgtagcgaggagtaagcatcagaggctgcggcgcctgaagcctgggtcacagcagacacctgatacatggcggctgtgacagtttgcaaggcacagagaacagcacccacttggggtagaaaggcttcccctaccctgggcccatgtctgaccctggggactctcaactgaactcctggctccttgctgagcttttgagggttagacccagccaagacagcccccagacctgcccctttcactaggcaanaggtcacctactccctcaaccacacttctgaggactcctgtgaggccccattgcccagagcacagctatgccccgggccctggctcaccctctgcctgccctgtccttcccctggctgatggactaattgcctgtcatgggcgtccagctcaaaggccacctcctcctagaagccattctggattcccatggcagatgtggccatccctccctgcaccccttagccatctggcaggagagtgtggcacacctgctcatctttgcctgtggggcgctcttccagagtgaggcctcactgggcagtatcagtccctgggtcactgttcccccagtgcctggttcagggtagactctctgtaaaggtgagtcaacccccacacctggaggcatctcagggagcagatgcccaatatagatgatcccccattccctgacagtggagccctctttccctgcagcctacattgcagatgcccaggctagcgagggccctggcctcacctcctggtggcggaccatgctgtcgacacgggccttctccttatccagctccgtgctggcccagcagacctgctggccagcgccctccagccgacccaccaacagctgcacctgcgcctccaactgctgcacctgctcctccagctgctgcacctgcctctccgctgccgccctgcgctcaccttcctcctgcagctgctgggcctttgcctctgcagcattaagtggacatgggatggggtagggcaggggagcgctgtactacctcagacctaggacgggagctcacatcccatctctgggcctcagagtcctcagccacaaaatggggctctagaccccacctgaggtgggtttggaaaatagaaggcgctttctcggtaggaggtggcaacccagtttggtcatcgccaatagtgtggttggtcaggcccaccctcctgtggctggttcccttcaactttgccctggatgctcaggggacagagatggacgatgctcatccagccacacccctggcttgagatgtggcatgggggcctatgatggggctccttacccacagcctgtgtggactcccgctgctgtttcagttctctctccagggtggccatctttgtctttaggtcacttgtttctatggcagccaagagagaggcccttcagagggtcccatggacctggccggcggccttcatgcccagtgtgccccgtggagtggaggcagcccatcgcctgcagaggggccgcctgcggccatgggaggagctctagggaggctggtggaagcggctgggcccttacccaccctgcttctcatgggctggctgccatgtgtctacacctctctgggccttggtgtcgtccatggaggcaactgtgatgaggctcagaaagggcaaatccctcaggcctcccatcagtgggcactggccatcttctggtgccaggaactttgtctctaatggcttttgccacaaccagagaggctgctctgcttggctggaagtgccaggggaataactctctggaagtagccctcaatgactgacagtgcaagtggatacatacctcggttccctcactgaccgatggacgagtctgggcaagcgtcctagcccagctcctggtggccccagtgggactgagatcacagtgtcaccaccggatgaacacccccttccttgctgccctcccttccctgcctcttgcctgtgtcccagcctgggttcttccacacaaaccacttgccctggaagccctgtctcacaaacatccatgcaaaggctgtggcagagcccctgggcaccaggcgtctggcctctggggcacagacctgtgagcagctgctgtttgtcgtgctcccactcagacaggcactgctcatcctcctccgcctgtcgccgccgtgccccctgctcctgtttcagcgcctgctccagcttgcccgcctgcttcctcaggccatccttctgcccttcagcctcctccagctgggccctgagggcctccacatgcttactgaggcgcgtcaggtctttcctctgctctgctgcccagcggcccacggtggcagccggcagtggcctgagccccatgctgtcctgcaccagttgctggaactggcctaaggacgagggcaggttctggctctgacacaggctgatgaccaccttgcccaccttctgcaggcttccctggacgctggcgcatgcgtcacagggcaccagggccgtctcaatggtctgggagtggacactcctggtgttcttgaaggtcgtggctgggaactgcagggaggctctgacagggatgctctctggctcttggcaggtctggggcaagcctagcactggggaggagggcttgattaacttggtagtcagatattcagggctcctggctggctcgcccttggtggtgggcttggaggtgggagtctccctttggtttgcccctttctgtgttcagaaaaagacaagggaaagcaggtgagggagagagtagagagggaggtgactggttccctgggggatgttctgtgacagtgtgacagccttgcctgacactcagaccctcaaatgttctctgacaccgacgtgaataagagagaactttctccctctgttactctgactcagcttactacagccaggtctcctctctgcggcccgcaccccaagctccaggcttgatctgattgtatgcatggtgttgggaaggtgatggtgacggtcacagctgctggttactgggctcttgcttactggacctgcctgctcttgtgtcaccataaccactctcagttttagtttccttcccatcatgggaacagtggttcttccccagtgggtggttgtgtggattacgggatagccnataacaaacaggggtcacatgacctccgttgtatagatgaagaaactgcggttcaaagtaggcaagatttttccaaagtcccacagggatgtcagagccagggagcaaggcatgatccccaaggcctgcgttcttaaccgccacactgtgtggggcttgattgggagggcggtgggagccagtaaaggctgtggtgcacatagtggtaggctaggaagccagagctggggcgaggtgtgaaggccaccacagtggggagatagaggctgaggctgacccacctgagacagaggctgggacccacctgggggagtggctgctggtggagcgtgcccagcctcagcaggctgtcccagaagcgccgcaccgtgagccccacggacatgcagggccccgcagcctgtgcagggggcatcatctgctctgagccaaggttctccaagtagctcatacagctttgaagcagcagcaggagcctgcgggcagagatgctaggttgctggggcccaggctggtgctaacataccctcagaccatacaaccgcagctctggctctggggaactggcccaggcatcaagagcttggagagtctcagaatatgctctgctgggccagcttcaaacctaacccaggggctacttcctcagggaagccctccctggccacagcctcagcttgggagcctcttctgtgtctcctgggtggcacttctgcctggctcttctccactggaccagggagctctgtgaagccaggcctggccttgcctcagttgtatcctgagtccttgaaaagttctgggtgaatggctgccttatatccagtggcccggagcctccacttgatagatgacagagctgagacccagagaggggaagagcttgcccacagacacacattgatagggcagagcagggagtgtgcacagtctcctgaggctagtcaggggcttctgcagggtgagctgcttctgtgacagtggagacctgtgtcaagacagctaggtctctgtcctaacctccaagtttaaaactacagtcaggcatgaattgtaagaaaaaggagtattataataaaaagctaagtttgcatttg

SEQ ID NO: 349906 - DNA, 8568 bp, Homo sapiens
  misc_feature (2765)..(2765): n is a, c, g, or t
  misc_feature (4591)..(4591): n is a, c, g, or t
  misc_feature (7471)..(7471): n is a, c, g, or t
tatgagggggggggtgggagggggggtataggtatatattacaaaccgaagctcctcactattttccgactacctggggccatgtccccgggggccccaagccagacgttcccagccgcgttaaccccgcgcctgcttatcccccttgggcctggcagaaacgggacggtaagtggcctcgggatactttgccgcccccctttttttttgggattttatttatttattttatttttatttcttgagatggagtttcactcttgttgcccaggctggagtgcaatggcgtgatctcgcctcactgcaacctccgcctcccgggttcaagcaattctcctgtctcagcctcccaagtagctgggattacagacatgcgccaccacgcccggctaattttgtatttttagtagagacggggtttctccatgttggtcaggctggtctcgaactcccgatctcaggtgatccgcctgcctcggcctcccaaagtgctgggattacagacgtgagccactgcgcctggcttctcaaagggattttatgcccatggttgggttctgtcttatagcaagctgacctgaagatagggaaagtatttgagtgtgagccttgccctaaccacatgagcctattcaaagtagttttctgctggtagaagaggaggaagtcagggatttgaagcatgtgggggattcagcacatgagaaatcctctgttgttgacttgaagatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttggtgggcgcctgagagagctactcagctgtgaggtccttcccctggacttgagcacaggccttctggctcagggtgctgagggatggtgctcccctgtgaggggggtgcccggggcaccccagcctccctcaggaactcccaggcccctcagaagcaggaagttgggctgaccaaagctgtggtagctcagctatatacatggcccctcttgacccttctctgtgaactgaggtgctctacctgacggcctcttcaccaagggaaaatgcttcaggcatttgggagcgtgcgccctgagaaggcctcagcaagtttttggagattgtccttcacagaaacggggtcccattatattgtccaggctggtctcaaactcctgggctcgagtgatctgcccgcctcagcctctcaaattgttgggattacaggcatgagccgccgcacccggcctgacgaggcttcttgctgcacttaaaggaatgacagctatagagggcatatgggactggaaggcatcggatccataacatcctcacgccttctggaaatgtgaaaaatgtttcacaaaagcacagcctaaggcctcatgtgatgaggtgggctctccacaagttcccggggcagagtctgaagacctgctgctggataggggcttcctcctggtccccaagggcccgccctctcaggcccaccttgaggccaccctgctgggccacttcccggattttggacagcattgattggagccgcccgttctcctcctgtaggacccggatgcggatgtcgttggcctgcacttgcctctccatgtgatctgtgacgttgccagagtctgtgggacatgttatctgggattccacgctgctggatctgcctcctgtgcccaatgggacaggaccttagaagggaggcacaccagcttgggcaggtggcctggaggcacaaaggagctgtgtagtgcaccaggcctcctagctcatcttccttctcccgaggccttattcccccttccctgtcccccaacctgcagggaagatgaccatagtattataaaatctgagagctgggtgggacctagagctctcaaaagacttagcaaggccgggcgcggtggctcacgcctgtaatcccagcactttgggaggcccaggtcaggggatcattaagtcaagagatcaagaccatcctggccaacatggtgaaaccccgtctctactaaaaatagaaaaatgagctgggtgtggtggcgggcccccgtagtcccagctactcaggaggctgaggcaggagaatcacttgaacccaggaggtggaggttgcagtgagcagagattgtgccactgcactccagcctggcaacagagtgagactctgtctcaaaaaaaaaaaaaaaaaaaaagacttagcaaataagcatgagaggagagtgaatctctgacaaggccccccgttttggacaggctacagccaaagtgagctgtccaaggtcacacggccagctcaagcttgggaacggcaggaattccgccaggctgctcttcccctgcttttgtgatggatgcttccttctggctccaggagcccgggagaattgctgccccttctggttcagtttcctgctatgggaaatagctatggggctatgacctgcctcacaaggtggttgagaaggggacagaagggcctggatgatgtctcacgagcagctaactgcacatcttcctgccagctctgcaaanggatttgccctagtgctttaggggtctggaggggctgggagaacccaggtcacctgatatccaatcctgtgccaagatgggtacctagcactcctatgccatggggtccaggacagtgggcagctggaggctgtgtccttgggactagtcccatggtgtggtttggggacccattccaagaaccaagaagggggacacacagaagtcgagcaagaattagcatgtgacgtagtgaagagcacaggctgtggggacaaccagacctgtgtctgcgtttggctgttgtgactagaggcagtcacatcactgttgggctttcacgtccctgtctatgcagagtggatgacgcatgaagcacttgcgtgctgtggtgggtccacaggggctgcgctgctggccgcctggctttaacacccttgctgcaggctagggagctgcagtccccagtgtcctgcccacacgagccctcagctgctggccctgagccccagcatgcccttggcaccatccccagtcccctaccatggatctgggtctcggtgggcctgtgcaggtctgggaaggccaccagcagccgctcccgctccttcagctcctccagctcccgttctagctccaggatggttagccgcaggtccgtagtcgcctgctccaggccttgcttctccctctgcaggctctgcagcagctcctgggacagacggaggctcaggcctggctcctgagtgagctacatggtactcagcgccctggggcaccgtccctacccaagaaaagacatgggacaggcctgcaggcactcagttggccggagacttctctggcaaaaaggaagacccccaccctcacctgctgggccctgagctggcattgcccctgctcccgctcgctctgcagctgctcctccacgcgggcccgctgggcctcagcctcgtccaggctgccccgcagctcctcacgttcctggtccaggctgtccagctgctttagcagggctcgctgcttggcctgcagagactaagcaggaacggacaagcagggaggctgtgagacccacagggctaggcccagccatgtggaactaaggaggctacagcatctactacccctcggctgctacccccctggggtgtgtgtctgtgtctagggaatgctggtcacatgcgtggaagggtaggggtcgggggaagctggcagcaggcagatgcacaccggacctggtcaaggccaggatcccagcttgaagaccccggcccttggaacgcagatggctggctctgggggtctcacccccacttccttccagtcatacacagaccccacttggagaggaattctgggaactaagtttttcttctcctcgggtctccagtgtcacatcatcccatgttgctgaagcccacatttcctaacacccactgaatggaaagcaggaagaactaacgctggactgctcggagtcctggctccacctctcactagctgtgtggccttgggcaacttccttaacctcactcaataaggctgtttcctcattcgtaaaatgggggtgacaagagtatctacctcctgttgctgtagcgaggagtaagcatcagaggctgcggcgcctgaagcctgggtcacagcagacacctgatacatggcggctgtgacagtttgcaaggcacagagaacagcacccacttggggtagaaaggcttcccctaccctgggcccatgtctgaccctggggactctcaactgaactcctggctccttgctgagcttttgagggttagacccagccaagacagcccccagacctgcccctttcactaggcaanaggtcacctactccctcaaccacacttctgaggactcctgtgaggccccattgcccagagcacagctatgccccgggccctggctcaccctctgcctgccctgtccttcccctggctgatggactaattgcctgtcatgggcgtccagctcaaaggccacctcctcctagaagccattctggattcccatggcagatgtggccatccctccctgcaccccttagccatctggcaggagagtgtggcacacctgctcatctttgcctgtggggcgctcttccagagtgaggcctcactgggcagtatcagtccctgggtcactgttcccccagtgcctggttcagggtagactctctgtaaaggtgagtcaacccccacacctggaggcatctcagggagcagatgcccaatatagatgatcccccattccctgacagtggagccctctttccctgcagcctacattgcagatgcccaggctagcgagggccctggcctcacctcctggtggcggaccatgctgtcgacacgggccttctccttatccagctccgtgctggcccagcagacctgctggccagcgccctccagccgacccaccaacagctgcacctgcgcctccaactgctgcacctgctcctccagctgctgcacctgcctctccgctgccgccctgcgctcaccttcctcctgcagctgctgggcctttgcctctgcagcattaagtggacatgggatggggtagggcaggggagcgctgtactacctcagacctaggacgggagctcacatcccatctctgggcctcagagtcctcagccacaaaatggggctctagaccccacctgaggtgggtttggaaaatagaaggcgctttctcggtaggaggtggcaacccagtttggtcatcgccaatagtgtggttggtcaggcccaccctcctgtggctggttcccttcaactttgccctggatgctcaggggacagagatggacgatgctcatccagccacacccctggcttgagatgtggcatgggggcctatgatggggctccttacccacagcctgtgtggactcccgctgctgtttcagttctctctccagggtggccatctttgtctttaggtcacttgtttctatggcagccaagagagaggcccttcagagggtcccatggacctggccggcggccttcatgcccagtgtgccccgtggagtggaggcagcccatcgcctgcagaggggccgcctgcggccatgggaggagctctagggaggctggtggaagcggctgggcccttacccaccctgcttctcatgggctggctgccatgtgtctacacctctctgggccttggtgtcgtccatggaggcaactgtgatgaggctcagaaagggcaaatccctcaggcctcccatcagtgggcactggccatcttctggtgccaggaactttgtctctaatggcttttgccacaaccagagaggctgctctgcttggctggaagtgccaggggaataactctctggaagtagccctcaatgactgacagtgcaagtggatacatacctcggttccctcactgaccgatggacgagtctgggcaagcgtcctagcccagctcctggtggccccagtgggactgagatcacagtgtcaccaccggatgaacacccccttccttgctgccctcccttccctgcctcttgcctgtgtcccagcctgggttcttccacacaaaccacttgccctggaagccctgtctcacaaacatccatgcaaaggctgtggcagagcccctgggcaccaggcgtctggcctctggggcacagacctgtgagcagctgctgtttgtcgtgctcccactcagacaggcactgctcatcctcctccgcctgtcgccgccgtgccccctgctcctgtttcagcgcctgctccagcttgcccgcctgcttcctcaggccatccttctgcccttcagcctcctccagctgggccctgagggcctccacatgcttactgaggcgcgtcaggtctttcctctgctctgctgcccagcggcccacggtggcagccggcagtggcctgagccccatgctgtcctgcaccagttgctggaactggcctaaggacgagggcaggttctggctctgacacaggctgatgaccaccttgcccaccttctgcaggcttccctggacgctggcgcatgcgtcacagggcaccagggccgtctcaatggtctgggagtggacactcctggtgttcttgaaggtcgtggctgggaactgcagggaggctctgacagggatgctctctggctcttggcaggtctggggcaagcctagcactggggaggagggcttgattaacttggtagtcagatattcagggctcctggctggctcgcccttggtggtgggcttggaggtgggagtctccctttggtttgcccctttctgtgttcagaaaaagacaagggaaagcaggtgagggagagagtagagagggaggtgactggttccctgggggatgttctgtgacagtgtgacagccttgcctgacactcagaccctcaaatgttctctgacaccgacgtgaataagagagaactttctccctctgttactctgactcagcttactacagccaggtctcctctctgcggcccgcaccccaagctccaggcttgatctgattgtatgcatggtgttgggaaggtgatggtgacggtcacagctgctggttactgggctcttgcttactggacctgcctgctcttgtgtcaccataaccactctcagttttagtttccttcccatcatgggaacagtggttcttccccagtgggtggttgtgtggattacgggatagccnataacaaacaggggtcacatgacctccgttgtatagatgaagaaactgcggttcaaagtaggcaagatttttccaaagtcccacagggatgtcagagccagggagcaaggcatgatccccaaggcctgcgttcttaaccgccacactgtgtggggcttgattgggagggcggtgggagccagtaaaggctgtggtgcacatagtggtaggctaggaagccagagctggggcgaggtgtgaaggccaccacagtggggagatagaggctgaggctgacccacctgagacagaggctgggacccacctgggggagtggctgctggtggagcgtgcccagcctcagcaggctgtcccagaagcgccgcaccgtgagccccacggacatgcagggccccgcagcctgtgcagggggcatcatctgctctgagccaaggttctccaagtagctcatacagctttgaagcagcagcaggagcctgcgggcagagatgctaggttgctggggcccaggctggtgctaacataccctcagaccatacaaccgcagctctggctctggggaactggcccaggcatcaagagcttggagagtctcagaatatgctctgctgggccagcttcaaacctaacccaggggctacttcctcagggaagccctccctggccacagcctcagcttgggagcctcttctgtgtctcctgggtggcacttctgcctggctcttctccactggaccagggagctctgtgaagccaggcctggccttgcctcagttgtatcctgagtccttgaaaagttctgggtgaatggctgccttatatccagtggcccggagcctccacttgatagatgacagagctgagacccagagaggggaagagcttgcccacagacacacattgatagggcagagcagggagtgtgcacagtctcctgaggctagtcaggggcttctgcagggtgagctgcttctgtgacagtggagacctgtgtcaagacagctaggtctctgtcctaacctccaagtttaaaactacagtcaggcatgaattgtaagaaaaaggagtattataataaaaagctaagtttgcatttg

SEQ ID NO: 349907 - DNA, 8091 bp, Homo sapiens
  misc_feature (2288)..(2288): n is a, c, g, or t
  misc_feature (4114)..(4114): n is a, c, g, or t
  misc_feature (6994)..(6994): n is a, c, g, or t
cacaggtggacctgtttaagcgccgcgtggtgcggagactggcatccctcaagacacggcgctgccggctgaacagggcagcgcagggcctcccagatccgggtactgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctggatggagggagccccatggcaaggaaggtggacggcctctaggagccgtgagaggacctggcttacagccagccagcgaggacatggggacctcagtcccacagccgcaaggatcggaattctgccaacaagtggagcttggaagccaattcttccccagaaccggcagaaaggaacgcaacctggtagatgcctcaatttcagccctctgggacccggagcaaaaaaacccagccacacagaacctggacttctgactgccagaactgggagctaatgaatacatggcacggagttggtgggcgcctgagagagctactcagctgtgaggtccttcccctggacttgagcacaggccttctggctcagggtgctgagggatggtgctcccctgtgaggggggtgcccggggcaccccagcctccctcaggaactcccaggcccctcagaagcaggaagttgggctgaccaaagctgtggtagctcagctatatacatggcccctcttgacccttctctgtgaactgaggtgctctacctgacggcctcttcaccaagggaaaatgcttcaggcatttgggagcgtgcgccctgagaaggcctcagcaagtttttggagattgtccttcacagaaacggggtcccattatattgtccaggctggtctcaaactcctgggctcgagtgatctgcccgcctcagcctctcaaattgttgggattacaggcatgagccgccgcacccggcctgacgaggcttcttgctgcacttaaaggaatgacagctatagagggcatatgggactggaaggcatcggatccataacatcctcacgccttctggaaatgtgaaaaatgtttcacaaaagcacagcctaaggcctcatgtgatgaggtgggctctccacaagttcccggggcagagtctgaagacctgctgctggataggggcttcctcctggtccccaagggcccgccctctcaggcccaccttgaggccaccctgctgggccacttcccggattttggacagcattgattggagccgcccgttctcctcctgtaggacccggatgcggatgtcgttggcctgcacttgcctctccatgtgatctgtgacgttgccagagtctgtgggacatgttatctgggattccacgctgctggatctgcctcctgtgcccaatgggacaggaccttagaagggaggcacaccagcttgggcaggtggcctggaggcacaaaggagctgtgtagtgcaccaggcctcctagctcatcttccttctcccgaggccttattcccccttccctgtcccccaacctgcagggaagatgaccatagtattataaaatctgagagctgggtgggacctagagctctcaaaagacttagcaaggccgggcgcggtggctcacgcctgtaatcccagcactttgggaggcccaggtcaggggatcattaagtcaagagatcaagaccatcctggccaacatggtgaaaccccgtctctactaaaaatagaaaaatgagctgggtgtggtggcgggcccccgtagtcccagctactcaggaggctgaggcaggagaatcacttgaacccaggaggtggaggttgcagtgagcagagattgtgccactgcactccagcctggcaacagagtgagactctgtctcaaaaaaaaaaaaaaaaaaaaagacttagcaaataagcatgagaggagagtgaatctctgacaaggccccccgttttggacaggctacagccaaagtgagctgtccaaggtcacacggccagctcaagcttgggaacggcaggaattccgccaggctgctcttcccctgcttttgtgatggatgcttccttctggctccaggagcccgggagaattgctgccccttctggttcagtttcctgctatgggaaatagctatggggctatgacctgcctcacaaggtggttgagaaggggacagaagggcctggatgatgtctcacgagcagctaactgcacatcttcctgccagctctgcaaanggatttgccctagtgctttaggggtctggaggggctgggagaacccaggtcacctgatatccaatcctgtgccaagatgggtacctagcactcctatgccatggggtccaggacagtgggcagctggaggctgtgtccttgggactagtcccatggtgtggtttggggacccattccaagaaccaagaagggggacacacagaagtcgagcaagaattagcatgtgacgtagtgaagagcacaggctgtggggacaaccagacctgtgtctgcgtttggctgttgtgactagaggcagtcacatcactgttgggctttcacgtccctgtctatgcagagtggatgacgcatgaagcacttgcgtgctgtggtgggtccacaggggctgcgctgctggccgcctggctttaacacccttgctgcaggctagggagctgcagtccccagtgtcctgcccacacgagccctcagctgctggccctgagccccagcatgcccttggcaccatccccagtcccctaccatggatctgggtctcggtgggcctgtgcaggtctgggaaggccaccagcagccgctcccgctccttcagctcctccagctcccgttctagctccaggatggttagccgcaggtccgtagtcgcctgctccaggccttgcttctccctctgcaggctctgcagcagctcctgggacagacggaggctcaggcctggctcctgagtgagctacatggtactcagcgccctggggcaccgtccctacccaagaaaagacatgggacaggcctgcaggcactcagttggccggagacttctctggcaaaaaggaagacccccaccctcacctgctgggccctgagctggcattgcccctgctcccgctcgctctgcagctgctcctccacgcgggcccgctgggcctcagcctcgtccaggctgccccgcagctcctcacgttcctggtccaggctgtccagctgctttagcagggctcgctgcttggcctgcagagactaagcaggaacggacaagcagggaggctgtgagacccacagggctaggcccagccatgtggaactaaggaggctacagcatctactacccctcggctgctacccccctggggtgtgtgtctgtgtctagggaatgctggtcacatgcgtggaagggtaggggtcgggggaagctggcagcaggcagatgcacaccggacctggtcaaggccaggatcccagcttgaagaccccggcccttggaacgcagatggctggctctgggggtctcacccccacttccttccagtcatacacagaccccacttggagaggaattctgggaactaagtttttcttctcctcgggtctccagtgtcacatcatcccatgttgctgaagcccacatttcctaacacccactgaatggaaagcaggaagaactaacgctggactgctcggagtcctggctccacctctcactagctgtgtggccttgggcaacttccttaacctcactcaataaggctgtttcctcattcgtaaaatgggggtgacaagagtatctacctcctgttgctgtagcgaggagtaagcatcagaggctgcggcgcctgaagcctgggtcacagcagacacctgatacatggcggctgtgacagtttgcaaggcacagagaacagcacccacttggggtagaaaggcttcccctaccctgggcccatgtctgaccctggggactctcaactgaactcctggctccttgctgagcttttgagggttagacccagccaagacagcccccagacctgcccctttcactaggcaanaggtcacctactccctcaaccacacttctgaggactcctgtgaggccccattgcccagagcacagctatgccccgggccctggctcaccctctgcctgccctgtccttcccctggctgatggactaattgcctgtcatgggcgtccagctcaaaggccacctcctcctagaagccattctggattcccatggcagatgtggccatccctccctgcaccccttagccatctggcaggagagtgtggcacacctgctcatctttgcctgtggggcgctcttccagagtgaggcctcactgggcagtatcagtccctgggtcactgttcccccagtgcctggttcagggtagactctctgtaaaggtgagtcaacccccacacctggaggcatctcagggagcagatgcccaatatagatgatcccccattccctgacagtggagccctctttccctgcagcctacattgcagatgcccaggctagcgagggccctggcctcacctcctggtggcggaccatgctgtcgacacgggccttctccttatccagctccgtgctggcccagcagacctgctggccagcgccctccagccgacccaccaacagctgcacctgcgcctccaactgctgcacctgctcctccagctgctgcacctgcctctccgctgccgccctgcgctcaccttcctcctgcagctgctgggcctttgcctctgcagcattaagtggacatgggatggggtagggcaggggagcgctgtactacctcagacctaggacgggagctcacatcccatctctgggcctcagagtcctcagccacaaaatggggctctagaccccacctgaggtgggtttggaaaatagaaggcgctttctcggtaggaggtggcaacccagtttggtcatcgccaatagtgtggttggtcaggcccaccctcctgtggctggttcccttcaactttgccctggatgctcaggggacagagatggacgatgctcatccagccacacccctggcttgagatgtggcatgggggcctatgatggggctccttacccacagcctgtgtggactcccgctgctgtttcagttctctctccagggtggccatctttgtctttaggtcacttgtttctatggcagccaagagagaggcccttcagagggtcccatggacctggccggcggccttcatgcccagtgtgccccgtggagtggaggcagcccatcgcctgcagaggggccgcctgcggccatgggaggagctctagggaggctggtggaagcggctgggcccttacccaccctgcttctcatgggctggctgccatgtgtctacacctctctgggccttggtgtcgtccatggaggcaactgtgatgaggctcagaaagggcaaatccctcaggcctcccatcagtgggcactggccatcttctggtgccaggaactttgtctctaatggcttttgccacaaccagagaggctgctctgcttggctggaagtgccaggggaataactctctggaagtagccctcaatgactgacagtgcaagtggatacatacctcggttccctcactgaccgatggacgagtctgggcaagcgtcctagcccagctcctggtggccccagtgggactgagatcacagtgtcaccaccggatgaacacccccttccttgctgccctcccttccctgcctcttgcctgtgtcccagcctgggttcttccacacaaaccacttgccctggaagccctgtctcacaaacatccatgcaaaggctgtggcagagcccctgggcaccaggcgtctggcctctggggcacagacctgtgagcagctgctgtttgtcgtgctcccactcagacaggcactgctcatcctcctccgcctgtcgccgccgtgccccctgctcctgtttcagcgcctgctccagcttgcccgcctgcttcctcaggccatccttctgcccttcagcctcctccagctgggccctgagggcctccacatgcttactgaggcgcgtcaggtctttcctctgctctgctgcccagcggcccacggtggcagccggcagtggcctgagccccatgctgtcctgcaccagttgctggaactggcctaaggacgagggcaggttctggctctgacacaggctgatgaccaccttgcccaccttctgcaggcttccctggacgctggcgcatgcgtcacagggcaccagggccgtctcaatggtctgggagtggacactcctggtgttcttgaaggtcgtggctgggaactgcagggaggctctgacagggatgctctctggctcttggcaggtctggggcaagcctagcactggggaggagggcttgattaacttggtagtcagatattcagggctcctggctggctcgcccttggtggtgggcttggaggtgggagtctccctttggtttgcccctttctgtgttcagaaaaagacaagggaaagcaggtgagggagagagtagagagggaggtgactggttccctgggggatgttctgtgacagtgtgacagccttgcctgacactcagaccctcaaatgttctctgacaccgacgtgaataagagagaactttctccctctgttactctgactcagcttactacagccaggtctcctctctgcggcccgcaccccaagctccaggcttgatctgattgtatgcatggtgttgggaaggtgatggtgacggtcacagctgctggttactgggctcttgcttactggacctgcctgctcttgtgtcaccataaccactctcagttttagtttccttcccatcatgggaacagtggttcttccccagtgggtggttgtgtggattacgggatagccnataacaaacaggggtcacatgacctccgttgtatagatgaagaaactgcggttcaaagtaggcaagatttttccaaagtcccacagggatgtcagagccagggagcaaggcatgatccccaaggcctgcgttcttaaccgccacactgtgtggggcttgattgggagggcggtgggagccagtaaaggctgtggtgcacatagtggtaggctaggaagccagagctggggcgaggtgtgaaggccaccacagtggggagatagaggctgaggctgacccacctgagacagaggctgggacccacctgggggagtggctgctggtggagcgtgcccagcctcagcaggctgtcccagaagcgccgcaccgtgagccccacggacatgcagggccccgcagcctgtgcagggggcatcatctgctctgagccaaggttctccaagtagctcatacagctttgaagcagcagcaggagcctgcgggcagagatgctaggttgctggggcccaggctggtgctaacataccctcagaccatacaaccgcagctctggctctggggaactggcccaggcatcaagagcttggagagtctcagaatatgctctgctgggccagcttcaaacctaacccaggggctacttcctcagggaagccctccctggccacagcctcagcttgggagcctcttctgtgtctcctgggtggcacttctgcctggctcttctccactggaccagggagctctgtgaagccaggcctggccttgcctcagttgtatcctgagtccttgaaaagttctgggtgaatggctgccttatatccagtggcccggagcctccacttgatagatgacagagctgagacccagagaggggaagagcttgcccacagacacacattgatagggcagagcagggagtgtgcacagtctcctgaggctagtcaggggcttctgcagggtgagctgcttctgtgacagtggagacctgtgtcaagacagctaggtctctgtcctaacctccaagtttaaaactacagtcaggcatgaattgtaagaaaaaggagtattataataaaaagctaagtttgcatttg

SEQ ID NO: 349908 - DNA, 8485 bp, Homo sapiens
  misc_feature (2682)..(2682): n is a, c, g, or t
  misc_feature (4508)..(4508): n is a, c, g, or t
  misc_feature (7388)..(7388): n is a, c, g, or t
cacaggtggacctgtttaagcgccgcgtggtgcggagactggcatccctcaagacacggcgctgccggctgaacagggcagcgcagggcctcccagatccgggtactgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctggggaaccgctactccgatgattagctgcccagctggactctgcacatggggatggacccttcctgcctgcaccccggtcctcagcctgggctcccaggacaggacaggatgggacagcaggatagacaggacagcaagcccagtgggtgggaggaaggatgagggccccaccatgtccacactgggaaggagggccccacagcttcagactgaggatctagggctgggacctgtcagtcaaggaagagaggtcactttgggaccttctctgcaatcctgtgacgtgagtctgccctccttacaggcagctcccaggtcaataaggaaagagaatatggggccagtgtagctgtcgccagggttctgggagctccctgtggcctgtctgggaattcctgggggctgagactacagtggccaggttttgtgcttatttattggggggtgggttgagggaagagctatctggccttggggtaccctggcctgaccgtctttcaggatacttcttgtcaaggctgtctgcctgttgcctttggtcctcaagcactgggagccatgggtcccactgcctgtccagcctggctcccttcctgggcctggctaggaccaaaggttttagaaaccgtcctgttctggaatccttggctgcggctttgtgttgctgaccgggatactcgaaaccccaggatcaatgtggtgcctcatccaggggcatcctttttttttttttttttttttttaaagagttggagtagggaaggtttaatagtaaaataaacgtggctatattttaacataagatgtaaaatgtgtataggtgttttaagattttaaaaagttaccttaggttctactgcctgtggtagatggaattctaagatggcccccaaggtctcccactaccacctgccgtgaacatgccttgcattaatataatttctggaactgggactcagagggattttatttatttattttatttttatttcttgagatggagtttcactcttgttgcccaggctggagtgcaatggcgtgatctcgcctcactgcaacctccgcctcccgggttcaagcaattctcctgtctcagcctctcaaattgttgggattacaggcatgagccgccgcacccggcctgacgaggcttcttgctgcacttaaaggaatgacagctatagagggcatatgggactggaaggcatcggatccataacatcctcacgccttctggaaatgtgaaaaatgtttcacaaaagcacagcctaaggcctcatgtgatgaggtgggctctccacaagttcccggggcagagtctgaagacctgctgctggataggggcttcctcctggtccccaagggcccgccctctcaggcccaccttgaggccaccctgctgggccacttcccggattttggacagcattgattggagccgcccgttctcctcctgtaggacccggatgcggatgtcgttggcctgcacttgcctctccatgtgatctgtgacgttgccagagtctgtgggacatgttatctgggattccacgctgctggatctgcctcctgtgcccaatgggacaggaccttagaagggaggcacaccagcttgggcaggtggcctggaggcacaaaggagctgtgtagtgcaccaggcctcctagctcatcttccttctcccgaggccttattcccccttccctgtcccccaacctgcagggaagatgaccatagtattataaaatctgagagctgggtgggacctagagctctcaaaagacttagcaaggccgggcgcggtggctcacgcctgtaatcccagcactttgggaggcccaggtcaggggatcattaagtcaagagatcaagaccatcctggccaacatggtgaaaccccgtctctactaaaaatagaaaaatgagctgggtgtggtggcgggcccccgtagtcccagctactcaggaggctgaggcaggagaatcacttgaacccaggaggtggaggttgcagtgagcagagattgtgccactgcactccagcctggcaacagagtgagactctgtctcaaaaaaaaaaaaaaaaaaaaagacttagcaaataagcatgagaggagagtgaatctctgacaaggccccccgttttggacaggctacagccaaagtgagctgtccaaggtcacacggccagctcaagcttgggaacggcaggaattccgccaggctgctcttcccctgcttttgtgatggatgcttccttctggctccaggagcccgggagaattgctgccccttctggttcagtttcctgctatgggaaatagctatggggctatgacctgcctcacaaggtggttgagaaggggacagaagggcctggatgatgtctcacgagcagctaactgcacatcttcctgccagctctgcaaanggatttgccctagtgctttaggggtctggaggggctgggagaacccaggtcacctgatatccaatcctgtgccaagatgggtacctagcactcctatgccatggggtccaggacagtgggcagctggaggctgtgtccttgggactagtcccatggtgtggtttggggacccattccaagaaccaagaagggggacacacagaagtcgagcaagaattagcatgtgacgtagtgaagagcacaggctgtggggacaaccagacctgtgtctgcgtttggctgttgtgactagaggcagtcacatcactgttgggctttcacgtccctgtctatgcagagtggatgacgcatgaagcacttgcgtgctgtggtgggtccacaggggctgcgctgctggccgcctggctttaacacccttgctgcaggctagggagctgcagtccccagtgtcctgcccacacgagccctcagctgctggccctgagccccagcatgcccttggcaccatccccagtcccctaccatggatctgggtctcggtgggcctgtgcaggtctgggaaggccaccagcagccgctcccgctccttcagctcctccagctcccgttctagctccaggatggttagccgcaggtccgtagtcgcctgctccaggccttgcttctccctctgcaggctctgcagcagctcctgggacagacggaggctcaggcctggctcctgagtgagctacatggtactcagcgccctggggcaccgtccctacccaagaaaagacatgggacaggcctgcaggcactcagttggccggagacttctctggcaaaaaggaagacccccaccctcacctgctgggccctgagctggcattgcccctgctcccgctcgctctgcagctgctcctccacgcgggcccgctgggcctcagcctcgtccaggctgccccgcagctcctcacgttcctggtccaggctgtccagctgctttagcagggctcgctgcttggcctgcagagactaagcaggaacggacaagcagggaggctgtgagacccacagggctaggcccagccatgtggaactaaggaggctacagcatctactacccctcggctgctacccccctggggtgtgtgtctgtgtctagggaatgctggtcacatgcgtggaagggtaggggtcgggggaagctggcagcaggcagatgcacaccggacctggtcaaggccaggatcccagcttgaagaccccggcccttggaacgcagatggctggctctgggggtctcacccccacttccttccagtcatacacagaccccacttggagaggaattctgggaactaagtttttcttctcctcgggtctccagtgtcacatcatcccatgttgctgaagcccacatttcctaacacccactgaatggaaagcaggaagaactaacgctggactgctcggagtcctggctccacctctcactagctgtgtggccttgggcaacttccttaacctcactcaataaggctgtttcctcattcgtaaaatgggggtgacaagagtatctacctcctgttgctgtagcgaggagtaagcatcagaggctgcggcgcctgaagcctgggtcacagcagacacctgatacatggcggctgtgacagtttgcaaggcacagagaacagcacccacttggggtagaaaggcttcccctaccctgggcccatgtctgaccctggggactctcaactgaactcctggctccttgctgagcttttgagggttagacccagccaagacagcccccagacctgcccctttcactaggcaanaggtcacctactccctcaaccacacttctgaggactcctgtgaggccccattgcccagagcacagctatgccccgggccctggctcaccctctgcctgccctgtccttcccctggctgatggactaattgcctgtcatgggcgtccagctcaaaggccacctcctcctagaagccattctggattcccatggcagatgtggccatccctccctgcaccccttagccatctggcaggagagtgtggcacacctgctcatctttgcctgtggggcgctcttccagagtgaggcctcactgggcagtatcagtccctgggtcactgttcccccagtgcctggttcagggtagactctctgtaaaggtgagtcaacccccacacctggaggcatctcagggagcagatgcccaatatagatgatcccccattccctgacagtggagccctctttccctgcagcctacattgcagatgcccaggctagcgagggccctggcctcacctcctggtggcggaccatgctgtcgacacgggccttctccttatccagctccgtgctggcccagcagacctgctggccagcgccctccagccgacccaccaacagctgcacctgcgcctccaactgctgcacctgctcctccagctgctgcacctgcctctccgctgccgccctgcgctcaccttcctcctgcagctgctgggcctttgcctctgcagcattaagtggacatgggatggggtagggcaggggagcgctgtactacctcagacctaggacgggagctcacatcccatctctgggcctcagagtcctcagccacaaaatggggctctagaccccacctgaggtgggtttggaaaatagaaggcgctttctcggtaggaggtggcaacccagtttggtcatcgccaatagtgtggttggtcaggcccaccctcctgtggctggttcccttcaactttgccctggatgctcaggggacagagatggacgatgctcatccagccacacccctggcttgagatgtggcatgggggcctatgatggggctccttacccacagcctgtgtggactcccgctgctgtttcagttctctctccagggtggccatctttgtctttaggtcacttgtttctatggcagccaagagagaggcccttcagagggtcccatggacctggccggcggccttcatgcccagtgtgccccgtggagtggaggcagcccatcgcctgcagaggggccgcctgcggccatgggaggagctctagggaggctggtggaagcggctgggcccttacccaccctgcttctcatgggctggctgccatgtgtctacacctctctgggccttggtgtcgtccatggaggcaactgtgatgaggctcagaaagggcaaatccctcaggcctcccatcagtgggcactggccatcttctggtgccaggaactttgtctctaatggcttttgccacaaccagagaggctgctctgcttggctggaagtgccaggggaataactctctggaagtagccctcaatgactgacagtgcaagtggatacatacctcggttccctcactgaccgatggacgagtctgggcaagcgtcctagcccagctcctggtggccccagtgggactgagatcacagtgtcaccaccggatgaacacccccttccttgctgccctcccttccctgcctcttgcctgtgtcccagcctgggttcttccacacaaaccacttgccctggaagccctgtctcacaaacatccatgcaaaggctgtggcagagcccctgggcaccaggcgtctggcctctggggcacagacctgtgagcagctgctgtttgtcgtgctcccactcagacaggcactgctcatcctcctccgcctgtcgccgccgtgccccctgctcctgtttcagcgcctgctccagcttgcccgcctgcttcctcaggccatccttctgcccttcagcctcctccagctgggccctgagggcctccacatgcttactgaggcgcgtcaggtctttcctctgctctgctgcccagcggcccacggtggcagccggcagtggcctgagccccatgctgtcctgcaccagttgctggaactggcctaaggacgagggcaggttctggctctgacacaggctgatgaccaccttgcccaccttctgcaggcttccctggacgctggcgcatgcgtcacagggcaccagggccgtctcaatggtctgggagtggacactcctggtgttcttgaaggtcgtggctgggaactgcagggaggctctgacagggatgctctctggctcttggcaggtctggggcaagcctagcactggggaggagggcttgattaacttggtagtcagatattcagggctcctggctggctcgcccttggtggtgggcttggaggtgggagtctccctttggtttgcccctttctgtgttcagaaaaagacaagggaaagcaggtgagggagagagtagagagggaggtgactggttccctgggggatgttctgtgacagtgtgacagccttgcctgacactcagaccctcaaatgttctctgacaccgacgtgaataagagagaactttctccctctgttactctgactcagcttactacagccaggtctcctctctgcggcccgcaccccaagctccaggcttgatctgattgtatgcatggtgttgggaaggtgatggtgacggtcacagctgctggttactgggctcttgcttactggacctgcctgctcttgtgtcaccataaccactctcagttttagtttccttcccatcatgggaacagtggttcttccccagtgggtggttgtgtggattacgggatagccnataacaaacaggggtcacatgacctccgttgtatagatgaagaaactgcggttcaaagtaggcaagatttttccaaagtcccacagggatgtcagagccagggagcaaggcatgatccccaaggcctgcgttcttaaccgccacactgtgtggggcttgattgggagggcggtgggagccagtaaaggctgtggtgcacatagtggtaggctaggaagccagagctggggcgaggtgtgaaggccaccacagtggggagatagaggctgaggctgacccacctgagacagaggctgggacccacctgggggagtggctgctggtggagcgtgcccagcctcagcaggctgtcccagaagcgccgcaccgtgagccccacggacatgcagggccccgcagcctgtgcagggggcatcatctgctctgagccaaggttctccaagtagctcatacagctttgaagcagcagcaggagcctgcgggcagagatgctaggttgctggggcccaggctggtgctaacataccctcagaccatacaaccgcagctctggctctggggaactggcccaggcatcaagagcttggagagtctcagaatatgctctgctgggccagcttcaaacctaacccaggggctacttcctcagggaagccctccctggccacagcctcagcttgggagcctcttctgtgtctcctgggtggcacttctgcctggctcttctccactggaccagggagctctgtgaagccaggcctggccttgcctcagttgtatcctgagtccttgaaaagttctgggtgaatggctgccttatatccagtggcccggagcctccacttgatagatgacagagctgagacccagagaggggaagagcttgcccacagacacacattgatagggcagagcagggagtgtgcacagtctcctgaggctagtcaggggcttctgcagggtgagctgcttctgtgacagtggagacctgtgtcaagacagctaggtctctgtcctaacctccaagtttaaaactacagtcaggcatgaattgtaagaaaaaggagtattataataaaaagctaagtttgcatttg

SEQ ID NO: 349909 - DNA, 1057 bp, Homo sapiens
cacaggtggacctgtttaagcgccgcgtggtgcggagactggcatccctcaagacacggcgctgccggctgaacagggcagcgcagggcctcccagatccgggtactgagacctgtgcggtgtgcctggactacttctgcaacaaacagtggctccgggtgctgccctgtaagcacgagtttcaccgagactgtgtggacccctggctgatgctccagcagacctgcccactgtgcaaattcaacgtcctggggaaccgctactccgatgattagctgcccagctggactctgcacatggggatggacccttcctgcctgcaccccggtcctcagcctgggctcccaggacaggacaggatgggacagcaggatagacaggacagcaagcccagtgggtgggaggaaggatgagggccccaccatgtccacactgggaaggagggccccacagcttcagactgaggatctagggctgggacctgtcagtcaaggaagagaggtcactttgggaccttctctgcaatcctgtgacgtgagtctgccctccttacaggcagctcccaggtcaataaggaaagagaatatggggccagtgtagctgtcgccagggttctgggagctccctgtggcctgtctgggaattcctgggggctgagactacagtggccaggttttgtgcttatttattggggggtgggttgagggaagagctatctggccttggggtaccctggcctgaccgtctttcaggatacttcttgtcaaggctgtctgcctgttgcctttggtcctcaagcactgggagccatgggtcccactgcctgtccagcctggctcccttcctgggcctggctaggaccaaaggttttagaaaccgtcctgttctggaatccttggctgcggctttgtgttgctgaccgggatactcgaaaccccaggatcaatgtggtgcctcatccaggggcatcctttttttttttttttttttttttaaagagttggagtagggaaggtttaatagtaaaataaacgtggctatattttaacataagatg

SEQ ID NO: 349910 - DNA, 1343 bp, Homo sapiens
gtcaggaaaatgaagttgctccaaagaacaggatgaatgaaagcattttattgaaaaactcgtgcagcaaaccaccatggcacacgtttacctatgtaacaaacctgcacatcctgcacatgtatcctggaacttaaataaaattaaaaaaataaaaataaaaactcagattcctctcaattttcagtccttgcatttaataatttcttaatcatttcccttccaacttttagcctgcacgagcatgtgtgaagcacagaaatcataccacatgcaaaaatctctaaaatatcttatcatctgaaggtactgggggatttcctatcccatctgaaatccgagctaataaacaccaaaccctaagtggcaaaaaccctactttcagatggtattgtttcctcaatcccagaggtagactcaaaactaatttgaaacctccctggatagaagagaattggcagtcctttccagctgggagcacctgctagtaatggaggggcctctgctgacagtgcttttatgaagcaggatggtttgtgaatttaccaacagtgaggtctcagacttgaccagtttaggattaccgtagacccaggagtagttctagactggaatctagatagttttcaggatggggaagatagattcaaaaccacctaagggcattctgggtacaaagcattgtgcaaggctttggtgatacagagaataaggtcttttttcccatacttcctcatctgccaaggttatctccaattgtacctttctctccagttccaagcttgcatcatgaagatggtgtgtgggaaggccatgacagatgaatccgacacatgcagctcccagaaaacagaagtttctactgtctcgtctacccaagttggccccaactgaggacccaatattggcctgtttgcaacagctagaattaaattttacttttaagtaagtttctattgtctccgtcagaaaccaaactactaaaaacacaaaaaagatggtaaaaggagtgatggcagtttggggagtcaatttttcattttcttactattgccttcttgcctacaaagctactgtttccactggtctatttcagaccacccaaaggccatttcaacaatcatcagtttctactcctaagtggcaccattcacagcacttggagaactgatttctacatacaaggcaaccaaaaaggaatatgctttaagttttcagtgtatggatactttcctttttagtaactttttttttttttcctgctggggatccattctgagatgatatatgctgaattagaacaaacttaagaaaacactttagaaatgggagagacataaaga

SEQ ID NO: 349911 - DNA, 1260 bp, Homo sapiens
gtggaaagaggggaagacataatctgccttcgaatgtgggaaggtgcagtgaaatgccttttcaagaagcaggaactggccagttcctgcttcgtgaaaccagttccttgcatttaataatttcttaatcatttcccttccaacttttagcctgcacgagcatgtgtgaagcacagaaatcataccacatgcaaaaatctctaaaatatcttatcatctgaaggtactgggggatttcctatcccatctgaaatccgagctaataaacaccaaaccctaagtggcaaaaaccctactttcagatggtattgtttcctcaatcccagaggtagactcaaaactaatttgaaacctccctggatagaagagaattggcagtcctttccagctgggagcacctgctagtaatggaggggcctctgctgacagtgcttttatgaagcaggatggtttgtgaatttaccaacagtgaggtctcagacttgaccagtttaggattaccgtagacccaggagtagttctagactggaatctagatagttttcaggatggggaagatagattcaaaaccacctaagggcattctgggtacaaagcattgtgcaaggctttggtgatacagagaataaggtcttttttcccatacttcctcatctgccaaggttatctccaattgtacctttctctccagttccaagcttgcatcatgaagatggtgtgtgggaaggccatgacagatgaatccgacacatgcagctcccagaaaacagaagtttctactgtctcgtctacccaagttggccccaactgaggacccaatattggcctgtttgcaacagctagaattaaattttacttttaagtaagtttctattgtctccgtcagaaaccaaactactaaaaacacaaaaaagatggtaaaaggagtgatggcagtttggggagtcaatttttcattttcttactattgccttcttgcctacaaagctactgtttccactggtctatttcagaccacccaaaggccatttcaacaatcatcagtttctactcctaagtggcaccattcacagcacttggagaactgatttctacatacaaggcaaccaaaaaggaatatgctttaagttttcagtgtatggatactttcctttttagtaactttttttttttttcctgctggggatccattctgagatgatatatgctgaattagaacaaacttaagaaaacactttagaaatgggagagacataaaga

SEQ ID NO: 349912 - DNA, 1503 bp, Homo sapiens
  misc_feature (527)..(527): n is a, c, g, or t
ggcatccatgagaaaaatgtcggaggaagagttttatctgttcaaaaatatctcttcagtggggccgtgggatgggcctcagtaccacattgcccctgtctgggccttctacctccaggcagctttcatgggcactgtcttccttatagggttcccactcaatgccatggtgctggtggccacactgcgctacaaaaagttgcggcagcccctcaactacattctggtcaacgtgtccttcggaggcttcctcctctgcatcttctctgtcttccctgtcttcgtcgccagctgtaacggatacttcgtcttcggtcgccatgtttgtgctttggagggcttcctgggcactgtagcaggtctggttacaggatggtcactggccttcctggcctttgagcgctacattgtcatctgtaagcccttcggcaacttccgcttcagctccaagcatgcactgacggtggtcctggctacctggaccattggtattggcgtctccatcccacccttctttggctggagcnggttcatccctgagggcctgcagtgttcctgtggccctgactggtacaccgtgggcaccaaataccgcagcgagtcctatacgtggttcctcttcatcttctgcttcattgtgcctctctccctcatctgcttctcctacactcagctgctgagggccctgaaagctgttgcagctcagcagcaggagtcagctacgacccagaaggctgaacgggaggtgagccgcatggtggttgtgatggtaggatccttctgtgtctgctacgtgccctacgcggccttcgccatgtacatggtcaacaaccgtaaccatgggctggacttacggcttgtcaccattccttcattcttctccaagagtgcttgcatctacaatcccatcatctactgcttcatgaataagcagttccaagcttgcatcatgaagatggtgtgtgggaaggccatgacagatgaatccgacacatgcagctcccagaaaacagaagtttctactgtctcgtctacccaagttggccccaactgaggacccaatattggcctgtttgcaacagctagaattaaattttacttttaagtaagtttctattgtctccgtcagaaaccaaactactaaaaacacaaaaaagatggtaaaaggagtgatggcagtttggggagtcaatttttcattttcttactattgccttcttgcctacaaagctactgtttccactggtctatttcagaccacccaaaggccatttcaacaatcatcagtttctactcctaagtggcaccattcacagcacttggagaactgatttctacatacaaggcaaccaaaaaggaatatgctttaagttttcagtgtatggatactttcctttttagtaactttttttttttttcctgctggggatccattctgagatgatatatgctgaattagaacaaacttaagaaaacactttagaaatgggagagacataaaga

SEQ ID NO: 349913 - DNA, 5264 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctggggggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaat

SEQ ID NO: 349914 - DNA, 726 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggtaagaattttcagatggattactattgttggtggtattatattaactattattactcgtaatgattattattcgtcacttctgcaaattgttaattttcttgtgaactctgatatttaaatacagctattttgtttatttttttaatatttttattttcatagatttaatatagtatgagttttaatctgttcttttcagggaaaggtattttatagccattaaatacaaaggtttctgttttccctcatcattttggtttaggatttgttaaaaagcaaaaataatgcaaattgaatttgattttatccccaaattggctatgtttttaggaacaggaattagtctcaatattcatttt

SEQ ID NO: 349915 - DNA, 439 bp, Homo sapiens
ggccccatgggtttggataaagaatggtgggcctgtagtagattttcatcatgtgagcttaatgttgtagaacttttcactgtctatgttagcttggtaatataaacagacatgatagatgtatttttcttgatactactttcagtgacaatgtgtctttgagctgacagtactagcaaatatgagtgctatttgcattcctattattttctcccagatagcagcagtcatgtgtaagaaaacactttgcattgaatgttaggaaccctgggttttactcctcataatctccctttttgtcatgatgagaaaatcacttaacctctgtaacaacaaatcacttccctcaatctgtgatattcgatttagatcagataaattttaagccggttctaagatctaagattaaaaaaacaaactaaaagcttcaggatcacca

SEQ ID NO: 349916 - DNA, 5210 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgattttttgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctggggggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaat

SEQ ID NO: 349917 - DNA, 4487 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactttctgatcatgaagacataaatcactggattgtatacagtgttcgatttagcaaagaggtacgaaacaatagatattgttggagtgaccaggtgaccatgaccattaaccaccaagaagcagatcacgatataaggcatccaacagaccaggaaggtgaatatcatt

SEQ ID NO: 349918 - DNA, 5039 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttgattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcaatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctggggggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaat

SEQ ID NO: 349919 - DNA, 4342 bp, Homo sapiens
ttttttttttggttatttcccagtcatctctctcagatgctcaggagccagagatattttgtttcctcctttccttgtgctcgcgtgactggtttacacatgacgttggaggttgatagagggtttatgcataagaacacactgtcaacgctggtttggggcactagagaacaaagataaagcaataatatagattaattttgttgtaatttttatttaatcacaacaggaaatgctctgtgtattgtcaatagtcatagattgttggttatacagaatggttatttatagtttaaaaaaattagcgagagcattggtagtgaacgtaccatttaatttgacctgtgtagagttcagcacatttttatagaaggttttggaaagatgtattatttaacttacaggtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctggggggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaat

SEQ ID NO: 349920 - DNA, 5209 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctgagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctggggggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaat

SEQ ID NO: 349921 - DNA, 5210 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctggggggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaat

SEQ ID NO: 349922 - DNA, 1583 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatggtagtatagaattttttatcaactgtaattttgcatttgtaattaatgttgtttattacttacatttgtacttagaatgtatctacctaattgatctcttcattgtttaatccatttagtgattatagctttgaaactttgggattactgaggaaaaatctgaaggatttccaattatttactttggaaaggagatttaacttacatgaatggataacaagagtttatgtgtggtggtgcctgtcatctccactaaagacaatttaggaggaaacagcccttccagtaaagccaaagagatttaggttatctatcaggaagtgattcagcctttaaggtctgtagtacattggaatacgcattatcaaaagagagcatggggatgggcgcagcggctcacacctgtaataccagcactttgggaggccaaagcgggaggattgcttgagctcaggagttcaagactgatgtggccaacatagcaagaccttgccctgtgccgaatttttgccttgaggccaaattcctataggagtcgattaaattcttaacatgtcatactggttcctggtgaaatgtatacgt

SEQ ID NO: 349923 - DNA, 2033 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagcaataaacaacacaacaccaaaaaaaaaactttggggcgcgctcgggcccccaaaaagattttttaaacccttcgtgtggcgcgcgcggccccaagggtcatgcacactggccacagggttcccaagaaaaacctggcccgacaaggggctgggttccccccaataa

SEQ ID NO: 349924 - DNA, 1056 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatcaccactgctcagccctagcgctgagccatcatactccccccggaaccccaagactttggtttcccgaactgccccgcgg

SEQ ID NO: 349925 - DNA, 608 bp, Homo sapiens
caaaatggattgggaatgacattatggaaacaaaaaattatttgactactttgtgtttggcattgcgatgagtgggaatgaagaataatactaagtcgcagtgagaaatagctgtatttgttcaaaagcgttctttaagactgtcattattgcagatgcgagcacatgtcaactcaagctggttcatttttcagaagaacatggagagatttcttcatgcgattatgccatcgacctttatccctctctatacaatggtaaggtctggactgaagacttttcctcattttgattttctgtttagctgttaaagaatacacaagaatactttttaaacttccctgcaggtcactttttccagaataagataccatgaggctgtgcagcgttggcattggcaaaaaaaggttggaacagttacattttatttattttttaatgtggtgttttgaaatgtcatagtattatgattatgtttgtttccaacaaatacagaaataatgggacagacaccaactgtttgccttccaaacagaaactgtcctgagtacagagagggaacagtgcttactgaaaaacattacaaggaggtggcaaagagagctttt

SEQ ID NO: 349926 - DNA, 458 bp, Homo sapiens
gcttcaggatcaccattttcattgaaggagtttctaccacgttgggcttctatggtctttcacaatttttaaaatttcttggagaatatatgaaattacatttaaaaatcaacttctatctttcttgcataatgccatgttactgtcattgaagtcaatatttctggtttcatttcagattgtatcccaaggtattcccatgagagcaagaatgatccactctctttcaggaaaaaagtctgcaattccctatgggacaaagtctcaggtaggtttaccccggagatcattgtgcattgattataaggaagtcaaagtctggaacttgcctcttgtttgatggcccctctctctccagccctatctctgacattgcttggctcagtctagaccccaggaatacagatactagttggcaagtttattcagaggagatgctcaaaacaagccccagccca

SEQ ID NO: 349927 - DNA, 447 bp, Homo sapiens
atgcagccaaacttttatttttaatgtgattaacattgttgcagaccaagaaggtaattagaataatggaattttaggactggaaaaacttcagtttttcccttttctgttttcttcttggcattcttgtttttcaacaaaacttcgtgatagttaatttagtaaacctgaaagaatttagcaggatttaatacctaatttgatgtctttatattcggattattttcctttgaaggaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcggtaagttctttttccctaggtaagtccctcaaatacttctgggtcagtctcagctaacaagtct

SEQ ID NO: 349928 - DNA, 1866 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagag

SEQ ID NO: 349929 - DNA, 5096 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttgattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctggggggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaat

SEQ ID NO: 349930 - DNA, 5207 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcaatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctggggggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaat

SEQ ID NO: 349931 - DNA, 5357 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggtatgacgaaagtgatcagagcaaaaaggcaccatttcagtgacagctaaagctactcaagacaccattttttgactgaagccaagagccttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtgctggtctccaggctgacaaggattcaaagttgtctctgaaactcctctttgtcatactgcacatataaaacgtcttttgtttccaacaagaggattttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcatcactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgaatttaagttgttttttgtttgttagcaggtgtggatgtggggttatgtggtcatgctcagatctacctaaatcaccccagagctttatgtcttttattcattctaattcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctggggggccaacgcctaaagatcataatatcacacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaat

SEQ ID NO: 349932 - DNA, 1905 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctccgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagag

SEQ ID NO: 349933 - DNA, 822 bp, Homo sapiens
gcttaaaaatttctgtgtcttacacagaagatagaaaaaatagagtgtctccaattggatggattttttaaaaaatttggttattgtaatggatttattttttcttagagctgagctgattgtactttggccaactaatgggttaatactgtcaagggaaattagccctgactaaacattgccgctggctcatgaatgcactaggcttggggcagtataaaaactcagagaaatcagtgtgtaggagacacagaaatcagtgtcactcagtgacagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactggtaagtctaatgtttgattcatcagttgtcattttgagtaaagcacatgacactaatcttgtcatatgatttattggatttgtttgctgctcctttttatgggttatgaagagcaagactatgtacactacaaagtccttcttgaagcta

SEQ ID NO: 349934 - DNA, 2204 bp, Homo sapiens
  misc_feature (207)..(207): n is a, c, g, or t
cagctaccatggcccaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgncagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgagtttc

SEQ ID NO: 349935 - DNA, 1958 bp, Homo sapiens
cagctaccatggcccaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactgaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgagtttc

SEQ ID NO: 349936 - DNA, 1672 bp, Homo sapiens
ggagactcttttctgggaggcaaagagaggtccacaagaggaagacctgtcactaattaattacttttttgagacaaggtctggctttgctgcccaggctggagcacagtggtatgatcaaggtcaagccttgatctcccaggctcaagtgatcctccacctcagcctcccaagtaggtgggactataggcatgtgccatgatgcctagttaatttttttttttttttgagacgagatcttccttttttgcccaggttaatcttgaactcctgagctcaagcaatcctctcacctcagactcccaaagtactaagattactggcatgagccatcgtgcctggctatccacagaggttttaagccctgtgtgtgctaagtctgtctttctatccaacagttcatttgctcatccctcccttgccttgttctagaaagaccaagcagtacaacgtctcccttggctctgtttgacacaggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgagtttc

SEQ ID NO: 349937 - DNA, 679 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttg

SEQ ID NO: 349938 - DNA, 3201 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349939 - DNA, 374 bp, Homo sapiens
  misc_feature (40)..(40): n is a, c, g, or t
  misc_feature (124)..(124): n is a, c, g, or t
agcttttatttggttaggaatgagatagtaccatacatantgtctacaccttggtttcctactcatcatgacatctacatcatagaaacctccccaaatggacagacataaatgtaacattctntcaaatagctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349940 - DNA, 457 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtacctggcttatttcacttaacataatgacatccaattacatccatgtggttgcaaatgactgactcttgttctttttatggctgaattgtatttcattgtgtataagtaccacattttctttaccattcatctgttgaaggacatgcagtttgcttccacatcatagctgttgtaaacagagctgcaacagctaatttcctttctttggggtatatac

SEQ ID NO: 349941 - DNA, 3147 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgatagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349942 - DNA, 2988 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgcctgaggattccattgtggtaatgtccattaactgtgctatgcttatttctagaccacaga

SEQ ID NO: 349943 - DNA, 2173 bp, Homo sapiens
acgcgaggctgaggggcgggttgcgctgtgcgtccggaagtgtctcgcagatagtaaataatctcggaaaggcgagaaagaagctgtctccatcttcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349944 - DNA, 2342 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgc

SEQ ID NO: 349945 - DNA, 1002 bp, Homo sapiens
gggtgagctaccgtgctggcctggtaatcccagcacggtagctcacccttgtaatcccagcacggtagctcacccaaagtgctgggattacaaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349946 - DNA, 810 bp, Homo sapiens
gggccgctcccacttcagcctcctcagtagctgggaccacaggcatatgctacaaagggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349947 - DNA, 804 bp, Homo sapiens
ttccaccagcagcctcaggcgtgcgcggacggtgtgcggagtctagctttgtaccaggctgcagtgcagtagtgccatctcagtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349948 - DNA, 663 bp, Homo sapiens
cgtgctcggcaccctggccaacttgaaatttcctaattagctatctgagctatttaagtctgtacttcagtgtcttcattttttaaatgagagaactggactagattttatataagtacctacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349949 - DNA, 1494 bp, Homo sapiens
  misc_feature (1416)..(1416): n is a, c, g, or t
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtcctagtggaaacaaccccnctgtaactagattgatctatgcacttttcttgctgttggagtatgtgtagcttgtgtaaactgatggggacctctaga

SEQ ID NO: 349950 - DNA, 518 bp, Homo sapiens
ccgctttagaggatccccataataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349951 - DNA, 196 bp, Homo sapiens
taatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacagggtatttatatttcatgaaaactctgg

SEQ ID NO: 349952 - DNA, 3147 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtgaaaacaaatttgtttgactatttttgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349953 - DNA, 3147 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaatctgtgtgtagacattgtattccacaattttgaatggctgtgttttacctctaaataaatgaattcagagaaaaaaaaaaatgtactgat

SEQ ID NO: 349954 - DNA, 1936 bp, Homo sapiens
cccaatttctggacattttatagctgagcattacatgttcttaaagggtcatgaaacttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaaaaaaaaaatgtactgat

SEQ ID NO: 349955 - DNA, 2097 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaaagtcctgggattacaggcatgaccaccacgcctagctgtgtacaatctttttagatattcaccagcctctgcagcctcac

SEQ ID NO: 349956 - DNA, 1611 bp, Homo sapiens
acgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacagaggacaaaacttctgatgatgctgttgtactcgcctgttcaacagaagaagcagggttcccatcgaggaatgcaagaagtggaaaggcggtatactggataagctgcttatctataaagatcagaaaaacactcttttatcaccagcttatactgagttcaagctgaggggaaaaaaatgaaaacagagatgtacacataggcaattactactctcatatagccaaacaagaaatgacatgatgcactatgtcaat

SEQ ID NO: 349957 - DNA, 605 bp, Homo sapiens
atcgactgagccactgcactccagcctgggcaacagggcaagaccttgtctcaaaaaaaaaaaattaatttgaacacttctgttttgtgcagttttctctgttatattttactttttaaaaagaaaaagcggctgggcgcggtggctcacgcctgtaatcccagcactttgggaggccgaggtgggcggatcacctgatgtcgggagttcgagaccagcctggccaacatggagaaacctcgtctctactaaaaacacaaagaattagctgggcgtggtggcgcatgcctgtagtcccagctactcgggaggctgaggcaggagaatcgcttgaacctgggaggcagaggttgcagtgagctgagattgcaccactgcaccccagcctgggcaataagagtgaaaactccatctcaaaacaaaaacaaaaccaaccaaacaaagaaaaagttttagggcagtaaggaaaggaggtaaagtacacttggaagagggtcaagcaggtgacttgagagagtcaagtgcactgtttgatcttggacttggggtttgataggttggcatccttccggggcttgcgttaactttcccctggttcttccctt

SEQ ID NO: 349958 - DNA, 791 bp, Homo sapiens
tggtctcaaactcctggcctcaagtgatcctcctgcctcggcctcccaaagtactgggattacaggtataccattatgtccagctaaacctgttccttgaagaaagtgtgaacctcaaattcaaagcccctctctttctcttccctcatcagaatcggctcccagacacctgccactcgtgaatgcatctgataaactcactcacactgaggccttggggactgagtgagcagggcccagcagtggggagatatatgggggaagtgttagtggtggattattacattaacactcctttgctcttgacatctcatgcttacgcagtcttttccaatgcttgcagaattgcgggctactctgttcattatgcctgtgcctttgatacttcttttaatggcataaatgtccgttctgctctatcatggactatcctcttaatacttcctggcctcttttataattcaaccctgctacacacgccttatttaacccgtgataattccgctgtaaactatctccatctgatatctccatcttctttcttacacttaactttgacttctaactcgtgcctcttctgtacgctgtacaattaccccatttcttttccctcctcctttcctatttccctcactgcattaccctctaaactcacctttctctatttccccttcatcaaggtccatttttctttatttctcaaattgtctcccctcacttcatatctgcactctttcatgtactactcttcgtcattattaatactccctcttttatacccactctctcct

SEQ ID NO: 349959 - DNA, 772 bp, Homo sapiens
gtcaggagtttgagaccagcctggctaacatggtgaaaccccatctctactaaaaatactaaataaataaataaataaataaataaataagctgggtgtggtggtggaggctgtagtcccagctactcaggaggctgaggtgggaggatcacgagctggggagacggaggctgcagtgagctgagatggctccactgcactccagcctgggtgacagagcaagactccatctccaaaagaaaaagaaactataaacatcattgaaagaaactaaagaagacctaaataaatggaaggaaatcatgttcatggattaaaagacttaatattattaaaatttcattacttcagaagtgatctacagattcaacacaatccctatcaaaatcccagctgtggctgggtgtggcggctcacttctgtaatcctggcacttcaagagccaaggtgggaggattgtttgagccgagaaatttgagaccagcctggcaacatgatctctacaaaaaatatagaaattagccaggcgttgtggtgccagcctgtagtcccagctacccaggaggctgaggaaggaggatcgcttgagtccaggagtttgaggctgcagtgggctatgatcacatcactgctctccggcctgggcaacagtgcaaggtcatgtctcaaaaaaaaaatcccagctggctttttttttttttttgagatggagtcttgctctgttgcccaagctggagtgcagtggcggacgatcagcctcagggcaggccat

SEQ ID NO: 349960 - DNA, 720 bp, Homo sapiens
cacgtaagcatgatggggcacgggtgcgaggtggggcgcacagtgggagcgcgtggggcgtgatgggacacatcgggaggctgaggcacaaggatcacttgaacccgagaggcagaggttacagtgagccgagatcatgccactgcactccagcctgggtgacagagcaagactccatctccaaaagaaaaagaaactataaacatcattgaaagaaactaaagaagacctaaataaatggaaggaaatcatgttcatggattaaaagacttaatattattaaaatttcattacttcagaagtgatctacagattcaacacaatccctatcaaaatcccagctgtggctgggtgtggcggctcacttctgtaatcctggcacttcaagagccaaggtgggaggattgtttgagccgagaaatttgagaccagcctggcaacatgatctctacaaaaaatatagaaattagccaggcgttgtggtgccagcctgtagtcccagctacccaggaggctgaggaaggaggatcgcttgagtccaggagtttgaggctgcagtgggctatgatcacatcactgctctccggcctgggcaacagtgcaaggtcatgtctcaaaaaaaaaatcccagctggctttttttttttttttgagatggagtcttgctctgttgcccaagctggagtgcagtggcggacgatcagcctcagggcaggccat

SEQ ID NO: 349961 - DNA, 448 bp, Homo sapiens
gcagcaccacacctggctaatttttttatttttagtggagattgggtttcatcatgttggccaggctgatctcgaaagcctgacctcaagtgatccgcccaccttaggctcccaaagtgtggggagccaccgtcccggcgtattattacttttagagacgaggtcttgctgtgttttccaggctggagtacagtggctcaatcatagctcactgcagcctcaaactcctggccttaagcaatcctcctgcttcagcctcccaaagtgctgagattataggtgtgagccactgcacctggcctctctattctctccttcctctttctagaatttctattaggcggatgttgaatctcctgaattaatctctaattttcttcccttccctttcccttctccttcccttcccttccccttctctcccctcccctcccctcccttcccctct

SEQ ID NO: 349962 - DNA, 687 bp, Homo sapiens
gcagcaccacacctggctaatttttttatttttagtggagattgggtttcatcatgttggccaggctgatctcgaaagcctgacctcaagtgatccgcccaccttaggctcccaaagtgtggggagccaccgtcccggcgtattattacttttagagacgaggtcttgctgtgttttccaggctggagtacagtggctcaatcatagctcactgcagcctcaaactcctggccttaagcaatcctcctgcttcagcctcccaaagtgctgagattataggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacctaatcccagtgtccaggatgtaactagagagctacgggcatgcagaagttggaagatgagggaaggcatcacagaggctgtggggtgaactgacttcaaggaatgggtccttccctcagacccacaa

SEQ ID NO: 349963 - DNA, 3981 bp, Homo sapiens
  misc_feature (2811)..(2811): n is a, c, g, or t
  misc_feature (3785)..(3785): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349964 - DNA, 4081 bp, Homo sapiens
  misc_feature (2911)..(2911): n is a, c, g, or t
  misc_feature (3885)..(3885): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349965 - DNA, 4240 bp, Homo sapiens
  misc_feature (3070)..(3070): n is a, c, g, or t
  misc_feature (4044)..(4044): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccaggtaaagccctatcaccgggtctgcgcccctctccgtgtggagcccacctgcatgtactggctccccaacatgcacggcaggagcggcggcccagcacttggcactggccacttgcagtagagacggggttttgccatgttgaccaggctggtcttgaactcctgacctcaggcgatccgcccgccttgaactcccaaagtgctggattacaggtgtgagccactgtgcccggcacctaaacaacatagttttgatatagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349966 - DNA, 4658 bp, Homo sapiens
  misc_feature (3488)..(3488): n is a, c, g, or t
  misc_feature (4462)..(4462): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349967 - DNA, 4966 bp, Homo sapiens
  misc_feature (3796)..(3796): n is a, c, g, or t
  misc_feature (4770)..(4770): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagtgagtcctgggaagaggggaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccatttaggagttttttgtgagttatgtccttgttgcttttgcctctttttctttctagccttgattgtgccagaagacaatgtccctattcacacactctttctgcttttctgtgggcaggaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349968 - DNA, 4866 bp, Homo sapiens
  misc_feature (3696)..(3696): n is a, c, g, or t
  misc_feature (4670)..(4670): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagtgagtcctgggaagaggggaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccatttaggagttttttgtgagttatgtccttgttgcttttgcctctttttctttctagccttgattgtgccagaagacaatgtccctattcacacactctttctgcttttctgtgggcaggaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349969 - DNA, 4286 bp, Homo sapiens
  misc_feature (3116)..(3116): n is a, c, g, or t
  misc_feature (4090)..(4090): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349970 - DNA, 2758 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttggccaggatggtcttgatctcttgaccttgtgatccacctgcctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatagcgagaccctgtctctacaaaaaattaaaaaaaaaaaaaaaaacccagctgcgtgtggtggcacagcctcaaactcctgggctcaagcgatcctcccttggccttccagccactcaggaggctggggtgggaggatcgcttgaacccaggagtttgaggctgca

SEQ ID NO: 349971 - DNA, 3104 bp, Homo sapiens
  misc_feature (1934)..(1934): n is a, c, g, or t
  misc_feature (2908)..(2908): n is a, c, g, or t
tggtctcaaactcctggcctcaagtgatcctcctgcctcggcctcccaaagtactgggattacaggtataccattatgtccagctaaacctgttccttgaagaaagtgtgaacctcaaattcaaagcccctctctttctcttccctcatcagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349972 - DNA, 3069 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccgaaacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattacattctggggccacgaggaggcactcatcgtttcgttccaaccgccgccaacggccctggccctcgcgagctctggaactacagaggtcgcacgcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctgggtgagtggacaggg

SEQ ID NO: 349973 - DNA, 2853 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccgaaacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattacattctggggccacgaggaggcactcatcgtttcgttccaaccgccgccaacggccctggccctcgcgagctctggaactacagaggtcgcacgcccgggcagtgagtgtggatggcttggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgagcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctgggtgagtggacaggg

SEQ ID NO: 349974 - DNA, 2033 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagctcccagctacttgagaggctgaggtgggaggattgtttgaacccaggaggttgaggctacagtgagctgtgattgtgccactgcactccaggttgggtaatgcagcgagactgcgtctcaaaaaataaataaaataaaaaataaataaaagctccacctgtcttcc

SEQ ID NO: 349975 - DNA, 1497 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaagtctcattctgtcacccaggctggagtgcagtggcagaggttgcagtgagctgagattgcaccactgcaccccagcctgggcaataagagtgaaaactccatctcaaaacaaaaacaaaaccaaccaaacaaagaaaaagttttagggcagtaaggaaaggaggtaaagtacacttggaagagggtcaagcaggtgacttgagagagtcaagtgcactgtttgatcttggacttggggtttgataggttggcatccttccggggcttgcgttaactttcccctggttcttccctt

SEQ ID NO: 349976 - DNA, 1651 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttggccaggatggtcttgatctcttgaccttgtgatccacctgcctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcacgaagatcactgcagtgagctgagatcatgccactgcacttcagcctgggcgtcagagtgagaccctgtttctaaaataataataattttaaaaaatgatatttatggttgcattgggacggaagatca

SEQ ID NO: 349977 - DNA, 1266 bp, Homo sapiens
caaagtactgggattacaggtataccattatgtccagctaaacctgttccttgaagaaagtgtgaacctcaaattcaaagcccctctctttctcttccctcatcagaatcggctcccagacacctgccactcgtgaatgcatctgataaactcactcacactgaggccttggggactgaggtgagcagggcccagcagtggggagatatatgggggaagtgttagtggtggtgaatccatatggattcactcagtccttgcctcctcagaagaaagaattccaccaaggggcatgaggcagagtgagggaccgaggcaagttttagagcaggagtgaaagtttattaaaatgttttggggcaggtgctgggcgcggtggctcacgcctgtaatcccagcactttgggaggccgaggtgggcggatcacctgatgtcgggagttcgagaccagcctggccaacatggagaaacctcgtctctactaaaaacacaaagaattagctgggcgtggtggcgcatgcctgtagtcccagctactcgggaggctgaggcaggagaatcgcttgaacctgggaggcagaggttgcagtgagctgagattgcaccactgcaccccagcctgggcaataagagtgaaactccatctcaaaaaaaaaaaaaaaaaaaggtgcatgaaacatatgaagcaaaaagtgaaagtccccattcttttcctttttccagaggtgatttttgtggccaatctggtttcattccctcccagacacttttctaggcatctatgcgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtgggcaacttagcaaaacaccatctcttaaaaaaaaaaaaaaattagccaagcttggtggtgtaagcctgtagtcccagctacttgagaggctgaggtgggaggattgtttgaacccaggaggttgaggctacagtgagctgtgattgtgccactgcactccaggttgggtaatgcagcgagactgcgtctcaaaaaataaataaaataaaaaataaataaaagctccacctgtcttcc

SEQ ID NO: 349978 - DNA, 906 bp, Homo sapiens
  misc_feature (846)..(846): n is a, c, g, or t
  misc_feature (848)..(848): n is a, c, g, or t
  misc_feature (856)..(856): n is a, c, g, or t
  misc_feature (858)..(858): n is a, c, g, or t
  misc_feature (906)..(906): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaagctccacnancacgctgntnacttagtagaaaaccctggggtaggaggtggggctgctctagagtcgn

SEQ ID NO: 349979 - DNA, 1711 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccaggtaaagccctatcaccgggtctgcgcccctctccgtgtggagcccacctgcatgtactggctccccaacatgcacggcaggagcggcggcccagcacttggcactggccacttgcagtagagacggggttttgccatgttgaccaggctggtcttgaactcctgacctcaggcgatccgcccgccttgaactcccaaagtgctggattacaggtgtgagccactgtgcccggcacctaaacaacatagttttgatatagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaacttttctaccctgagtgcgagataagaacgatgggtggaagagagcaacgccagagcccaggtgcccagaggactttcttccagcttctgctgtccttctttgtggagagcaagtctcattctgtcacccaggctggagtgcagtggcagaggttgcagtgagctgagattgcaccactgcaccccagcctgggcaataagagtgaaactccatctcaaaaaaaaaaaaaaaaaaaggtgcatgaaacatatgaagcaaaaagtgaaagtccccattcttttcctttttccagaggtgatttttgtggccaatctggtttcattccctcccagacacttttctaggcatctatgcgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtgggcaacttagcaaaacaccatctcttaaaaaaaaaaaaaaattagccaagcttggtggtgtaagcctgtagtcccagctacttgagaggctgaggtgggaggattgtttgaacccaggaggttgaggctacagtgagctgtgattgtgccactgcactccaggttgggtaatgcagcgagactgcgtctcaaaaaataaataaaataaaaaataaataaaagctccacctgtcttcc

SEQ ID NO: 349980 - DNA, 1147 bp, Homo sapiens
  misc_feature (1087)..(1087): n is a, c, g, or t
  misc_feature (1089)..(1089): n is a, c, g, or t
  misc_feature (1097)..(1097): n is a, c, g, or t
  misc_feature (1099)..(1099): n is a, c, g, or t
  misc_feature (1147)..(1147): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccaggtaaagccctatcaccgggtctgcgcccctctccgtgtggagcccacctgcatgtactggctccccaacatgcacggcaggagcggcggcccagcacttggcactggccacttgcagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaagctccacnancacgctgntnacttagtagaaaaccctggggtaggaggtggggctgctctagagtcgn

SEQ ID NO: 349981 - DNA, 924 bp, Homo sapiens
gactaggctgggcaacatagtgagacctcatctctaaaattaaaaaaataaaagccaccagaaaaaaacctaaaaacatgccaagtgacatcagtctttgatgaaaatggcagcagaagagtgatgccatgggtgggggtgggaaatgctatttcagcagagagggagctgtcatggaagacaccatgtgcctgggcacggtggctcacgcctgtaatcccagcactttgggaggccgaggcgggtggatcacctgaggttaggagttcgagaccagcctgggcaataagagtgaaactccatctcaaaaaaaaaaaaaaaaaaaggtgcatgaaacatatgaagcaaaaagtgaaagtccccattcttttcctttttccagaggtgatttttgtggccaatctggtttcattccctcccagacacttttctaggcatctatgcgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtgggcaacttagcaaaacaccatctcttaaaaaaaaaaaaaaattagccaagcttggtggtgtaagcctgtagtcccagctacttgagaggctgaggtgggaggattgtttgaacccaggaggttgaggctacagtgagctgtgattgtgccactgcactccaggttgggtaatgcagcgagactgcgtctcaaaaaataaataaaataaaaaataaataaaagctccacctgtcttcc

SEQ ID NO: 349982 - DNA, 775 bp, Homo sapiens
aaaaaaattctccgccccgccttggggggccaaccccaaaaaacccccccccttgggggccccgcccggggggaacaccctggggccccggggttaaaaacggccccgggcacaaaaaaaaggagacccctttctcccccccaaaaaactccatctcaaaaaaaaaaaaaaaaaaaggtgcatgaaacatatgaagcaaaaagtgaaagtccccattcttttcctttttccagaggtgatttttgtggccaatctggtttcattccctcccagacacttttctaggcatctatgcgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtgggcaacttagcaaaacaccatctcttaaaaaaaaaaaaaaattagccaagcttggtggtgtaagcctgtagtcccagctacttgagaggctgaggtgggaggattgtttgaacccaggaggttgaggctacagtgagctgtgattgtgccactgcactccaggttgggtaatgcagcgagactgcgtctcaaaaaataaataaaataaaaaataaataaaagctccacctgtcttcc

SEQ ID NO: 349983 - DNA, 921 bp, Homo sapiens
  misc_feature (921)..(921): n is a, c, g, or t
agatcactggcatcagacatgcttctgctgatacatgtacacttcttttatttgtcttttcacagagacagagtctcgctctgtcacccaggctggagtgcagtggcgcagtctcagctcactgcaacctctgcctcccgggttcaagcgattctcctgcctcggcctcccaagtagctgggattacaagcgcacaccaccatgcctgactaaatttttatatttttggtagagatggggtttcaccatgttggccaggtggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatagcgagaccctgtctctacaaaaaacaaccccccccagctgcgtgtggtgcaccagcttaagttctgggctttcaggcccttcttcn

SEQ ID NO: 349984 - DNA, 885 bp, Homo sapiens
tagctgggattacgggtgcacaccaccacacctggctgatttatgtatttttttcgtagagacggggttttgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatagcgagaccctgtctctacaaaaaattaaaaaaaaaaaaaaaaacccagctgcgtgtggtggcacagcctcaaactcctgggctcaagcgatcctcccttggccttccagccactcaggaggctggggtgggaggatcgcttgaacccaggagtttgaggctgca

SEQ ID NO: 349985 - DNA, 831 bp, Homo sapiens
tagctgggattacgggtgcacaccaccacacctggctgatttatgtatttttttcgtagagacggggttttgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaaccataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatagcgagaccctgtctctacaaaaaattaaaaaaaaaaaaaaaaacccagctgcgtgtggtggcacagcctcaaactcctgggctcaagcgatcctcccttggccttccagccactcaggaggctggggtgggaggatcgcttgaacccaggagtttgaggctgca

SEQ ID NO: 349986 - DNA, 688 bp, Homo sapiens
gactaggctgggcaacatagtgagacctcatctctaaaattaaaaaaataaaagccaccagaaaaaaacctaaaaacatgccaagtgacatcagtctttgatgaaaatggcagcagaagagtgatgccatgggtgggggtgggaaatgctatttcagcagagagggagctgtcatggaagacaccatgtgcctgggcacggtggctcacgcctgtaatcccagcactttgggaggccgaggcgggtggatcacctgaggttaggagttcgagaccagcctgggcaataagagtgaaactccatctcaaaaaaaaaaaaaaaaaaaggtgcatgaaacatatgaagcaaaaagtgaaagtccccattcttttcctttttccagaggtgatttttgtggccaatctggtttcattccctcccagacacttttctaggcatctatgcgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgacccaggagttcgagaccagcctgggcaatatggtgaaatcccatctctaccaaaaaaa

SEQ ID NO: 349987 - DNA, 442 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttt

SEQ ID NO: 349988 - DNA, 654 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccaggtaaagccctatcaccgggtctgcgcccctctccgtgtggagcccacctgcatgtactggctccccaacatgcacggcaggagcggcggcccagcacttggcactggccacttgcagtagagacggggttttgccatgttgaccaggctggtcttgaactcctgacctcaggcgatccgcccgccttgaactcccaaagtgctggattacaggtgtgagccactgtgcccggcacctaaacaacatagttttgatataggtaagcatacagcatatattttgatgtatttcaggtaatttagtctaagaacaggaaaggacagaaaatgaacacaatttgtagttctttgttcttaacaaactaagaatactttgcttaaataagtagcaatgagaatgtaactcagtaattcatacaaa

SEQ ID NO: 349989 - DNA, 220 bp, Homo sapiens
taatttttgtatttttagtagagacggggttttgccatgttgaccaggctggtcttgaactcctgacctcaggcgatccgcccgccttgaactcccaaagtgctggattacaggtgtgagccactgtgcccggcacctaaacaacatagttttgatataggtaagcatacagcatatattttgatgtatttcaggtaatttagtctaagaacaggaaagg

SEQ ID NO: 349990 - DNA, 407 bp, Homo sapiens
gcatggggtacatggcatttcaagaaaataaattcttccatgagagggagttaactggtaggatggaaagtgagtttggagagagggtggctctaagagtcaacttatctgtctgtgtctagggatgtccttcctgagatccgtgctatctgcattgaggaaattgggtgttggatgcaaagctacagcacgtctttcctcaccgacagctatttaaaatatattggttggactctgcatgataaggtgggattcgagtcagtttccctttccgtttccttcatctttttcctgtcctaggacacttcaccttttcctgggcctgccactgagatattttacctagtgaccaatgattaacccatcaaggcgctgaaccttgaaactccgctagcactggggagggt

SEQ ID NO: 349991 - DNA, 484 bp, Homo sapiens
gtcttgaactcctgacctcaggcgatccgcccgccttgaactcccaaagtgctggattacaggtgtgagccactgtgcccggcacctaaacaacatagttttgatataggtaagcatacagcatatattttgatgtatttcaggtaatttagtctaagaacaggaaaggacagaaaatgaacacaatttgtagttctttgttcttaacaaactaagaatactttgcttaaataagtagcaatgagaatgtaactcagtaattcatacaaatagacaagaagacaagaaaatgatttgaggacagcttcaatcgcggtgtgaagaagaaagcagcaaaacgaccactgaaaacaacgccggtgagtcagccagttttcttttgtttttgaatcttgtgggggaagcagcccagctattcgggaggctgaggcaggagaatggcacgaaccccgggggcagagctggcagtgagccgagatcacgc

SEQ ID NO: 349992 - DNA, 135 bp, Homo sapiens
cagggcccagcagtggggagatatatgggggaagtgttagtggtggtgaatccatatggattcacctcagtccttgcctcctcagaagaaagaattccaccaaggggcatgaggcagagtgagggaccgaggcaa

SEQ ID NO: 349993 - DNA, 1993 bp, Homo sapiens
  misc_feature (1563)..(1563): n is a, c, g, or t
  misc_feature (1751)..(1751): n is a, c, g, or t
  misc_feature (1864)..(1864): n is a, c, g, or t
  misc_feature (1869)..(1871): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttggccaggatggtcttgatctcttgaccttgtgatccacctgcctcatcatcccaaagtgctgggattacaggcgtgagccactgcgcccagcatgttagacaatttttaattcatcctctctgtgctgttgttttctcagctgtgaaaggaatattctggtggggacaaggttacagagttgctgagagggtctcatgacatgaaggtactggccttggcacagtgcctgggggggcggggactccgcacatgcctgtgatgtcacagttactgtcagttcacagngaaccttccctccttttcctgttgactttcccacactcctgtaaccctccctccctcccttcttcctctctctctctctcactcacgcacacgcacacacacacacacacacacaacacacacactccattcactgtctccatgactctggagtaaactaacgtctcgagttgccattggaagccccnttgtcctcatttagactttcatgggttataggcacttttgacttcctggggtccttcttcagttaaaaaaaaaaattagaaaattaggccgggcgtggtggcacatgcctgtnatccnnncaccttggcctcccaaagtgctgggattacaggagtgagccaccatgcccagcctccgttgtcctcatttagactttcatgggttataggcacttttgacttcctggggtccttcttcagtt

SEQ ID NO: 349994 - DNA, 4222 bp, Homo sapiens
  misc_feature (3052)..(3052): n is a, c, g, or t
  misc_feature (4026)..(4026): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccaggtaaagccctatcaccgggtctgcgcccctctccgtgtggagcccacctgcatgtactggctccccaacatgcacggcaggagcggcggcccagcacttggcactggccacttgcagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349995 - DNA, 4105 bp, Homo sapiens
  misc_feature (2935)..(2935): n is a, c, g, or t
  misc_feature (3909)..(3909): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349996 - DNA, 5107 bp, Homo sapiens
  misc_feature (3937)..(3937): n is a, c, g, or t
  misc_feature (4911)..(4911): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccaggtaaagccctatcaccgggtctgcgcccctctccgtgtggagcccacctgcatgtactggctccccaacatgcacggcaggagcggcggcccagcacttggcactggccacttgcagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagtgagtcctgggaagaggggaggccagtgtctcagacctttgcccttccagggtcatctccctccacctgtcacagctgactcttccatctgtgcaggttgactgaggtcattcctgagttgcagtatgttgagagggtaatatttctgtcttctctaactccccatactcccttgtcttccactctccatttaggagttttttgtgagttatgtccttgttgcttttgcctctttttctttctagccttgattgtgccagaagacaatgtccctattcacacactctttctgcttttctgtgggcaggaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349997 - DNA, 4294 bp, Homo sapiens
  misc_feature (3124)..(3124): n is a, c, g, or t
  misc_feature (4098)..(4098): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349998 - DNA, 4394 bp, Homo sapiens
  misc_feature (3224)..(3224): n is a, c, g, or t
  misc_feature (4198)..(4198): n is a, c, g, or t
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaaacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgaggccctggcggatcacgggtgcccaggggctcggaggccgcctcctctgggaagcctgcccaggttccgatggactcccacaggcaatacccctgggccttcctcgcggcccctgttggccccaattcccccaccccctgcaaggtctgtgcctctcctgcagccccgccaccaactagggcgagaggagctcgcccccacccaaacgtattggttcgatgaaggaagggcccatggttctgccactggccctggacacccagtgctggtttcccgtggaagtccccctggactgagtggcggctgggtgctctagtgatttgcgacctggggcctctgactcccatcatgttgggaaagtcgttgaacctcaccggtgaaacgggcacagtgaagtcatttccccgaagtctcaggactctgtgtaaggctggggacaggggcttgttggggcctaagggcaccttgggaactgcaggagcccgttctgcctccataagacactcactcctggcagggtcccctctccgggcacagcccagatccacccccatcatccctctccatctgtggctccctgcccctcacagaggattcatcactctgttcagaatccccaggactccctagggaaggaggtcccagcctggcctcccaagaccgtgcttgcccaattccaggacttcctcacatggctcctacctccagcacagaagcggcactaaaccaggtggtcaatcagggagcaccaccgaggttctgaatggtccagggatgagcagtgatgcctcaagctaagccaatcaaagccttccctgggattgtctcaaggagtccgcagtgagattctgggtctcagtactgggaaagggtgaggctgaggctgcctgctgtcctgggggcctcaccctgccaccaacaggaagccacacagagggaagcagaaatgagacgcagccagtgagggcagggtacaaaggtgagatcccggagagacagatgctgggacatcatccttgggtactggttccaacagtgcctgcagatggagccaccctcggagagtccacaacagcagccaatccattctatgcgtgtctgagctactttaagtcgggtttttgactgtttgaatgagagtctcatcttggctaggcaccatggcgcaacaactggggaggtggaggtaggaagattgcttgaggccaagagtcccagagcagcctgggcaacctatcaagacgctgtctttacgaaaagaaaagaaactagctaggtgtggtggtgcgtgcctgtggtcccagctactggggaggctgaggtgggaggattgcttgagcccaggaagtggaggctgcagtgacctatgatggcaccactgtactccagcctgggtgacagagcaagacttcgtctcaaaaaaaaaaaaaaaggttggagaccagcctgggtaacagaccaagaccccgactctggaattaaaacaaaaaacaggatgtggttggtgttttgtaaccaagacgtttagagtaggatggttttcaggctatcaaatttactactatattgctcacaccagaagtccaaatatacacacaaattagatatatttttttgagatggagtcttgctttgtcacccaggatggagtgcagtggcacaatcatagctcactgcctcctccaatttctgggctcaagggatcctcntgcctcagctcacgcacacgcacacacacacacacacacacacacacactccattctctgtctccatgactctggagtaaactaacgtctcgagttgccattggaagccccattgtcctcattttgtttgtttgtttgtttattgagacggagttttgttcttgttgcccaggctggagtgcagtggcacgatctcggctcaccgcaacctctgcctcccaggttcaagcaattctcctgtctcagcctcccaagtagctgggattacaggtgtgcgccaccacgcctggctaattttgttatttttagtagagacggggtttcgccatgttggccgggctggtctcgaactcctgacctcgggtgatccacccacctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatngcgagaccctgtctctacaaaaaaaaaaacgcgcacagtgaaacacaaaacctctgtttggagcgcctttggccccttagaaaggtttctgagacacatgctgttggcacgcggggcacacatgtgtacgcacccgtgggaaagggtggtccaaggagaaactcgggcagacaagtcggtggtcttccccataaag

SEQ ID NO: 349999 - DNA, 2336 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttggccaggatggtcttgatctcttgaccttgtgatccacctgcctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcacgaagatcactgcagtgagctgagatcatgccactgcacttcagcctgggcgtcagagtgagaccctgtttctaaaataataataattttaaaaaatgatatttatggttgcattgggacggaagatca

SEQ ID NO: 350000 - DNA, 2877 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccgaaacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattacattctggggccacgaggaggcactcatcgtttcgttccaaccgccgccaacggccctggccctcgcgagctctggaactacagaggtcgcacggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctgggtgagtggacaggg

SEQ ID NO: 350001 - DNA, 2954 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaagaatcggctcccagacacctgccactcgtgaatgcatctgataaactcactcacactgaggccttggggactgagagtgcgatgacatggatcctgcggacaaaccgccccagggcgtacctagcaccgaagcatcaggcgccactaggtctccagctccttctcggatgacgtccttcagcacgccccggtcccccgagatgtccagcatcctctgacttaaccgctcgtacagggactgatggagaatgaaagccaggcctcagagccgcagacccacccggccacccctcagcgtctacgcccccgaaacgtctgggccctcacctggccgggggcgtcgtccccttccaggactccctggtttaacgcgcttccccccatgtcctagctgccctccctgtggcgtgagccttcggcctggtgcgccccgctgcccttcctggctgtgactctggtggggttccgaaggcccctttatgcccggcagacccctaccgacggcggcattacattctggggccacgaggaggcactcatcgtttcgttccaaccgccgccaacggccctggccctcgcgagctctggaactacagaggtcgcacgcccgggcagtgagtgtggatggcttggcaggtgagcctgctggagctggaggaccggcttcagtgtcccatctgcctggaggtcttcaaggagtccctaatgctacagtgcggccactcctactgcaagggctgcctggtttccctgtcctaccacctggacaccaaggtgcgctgccccatgtgctggcaggtggtggacggcagcagctccttgcccaacgtctccctggcctgggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctgcagccgcatgaaggaggagctcgcagccctcttctctgagctgaagcaggagcagaagaaggtggatgagctcatcgccaaactggtgaaaaaccggacccgaatcgtcgtgagtgccccttccctctgcccctgcctgggaccggccaccttcactttcctgtagagctcagttctcattggtcctttacagaaaaccatgccttccatataaagccagaactcaaagcattccgggg

SEQ ID NO: 350002 - DNA, 1954 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaaggtgacatacacagagataactctggctgttgtgcataggacctacaagtgggctggggttggtggttcacgcctgtaagcccaacactttgggaggctgaggtgggaggatcctttgagcccaggagtttgagaccagcttgggcaacatagtgagaccctgtctctaccaaaaaaaaaaaaaaaaaaaaaaaagacagatggagaaggatgggggtgtacactgtaggaaggagagcgatatttaatcagtaaccacttcctagggtattttaacatgccatcactaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagaatcgcttgaacccgggaggtggaggttgcggtcagccgagatcatgccactgcactccagcctaggcaacaagagtgaaactctgtcttaaaaaaaaaaattaaaaattatattcgggccgggcttggtggctcaatcctataataccagcaccttaggaggccaaggcaggaggatcacttgaggccaggagttcaagactggcctgggcaacataatgagaacccatctttaccaaaaaaataaaattacattaaaaattagctgggcac

SEQ ID NO: 350003 - DNA, 1924 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccatctcctccctctgtggtcatcattacacctccttgtttcctcctgtgctgagccctttccttgtgtccattccaccagacttttctaccctgagtgcgagataagaacgatgggtggaagagagcaacgccagagcccaggtgcccagaggactttcttccagcttctgctgtccttctttgtggagagcaagtctcattctgtcacccaggctggagtgcagtggcagaggttgcagtgagctgagattgcaccactgcaccccagcctgggcaataagagtgaaactccatctcaaaaaaaaaaaaaaaaaaaggtgcatgaaacatatgaagcaaaaagtgaaagtccccattcttttcctttttccagaggtgatttttgtggccaatctggtttcattccctcccagacacttttctaggcatctatgcgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtgggcaacttagcaaaacaccatctcttaaaaaaaaaaaaaaattagccaagcttggtggtgtaagcctgtagtcccagctacttgagaggctgaggtgggaggattgtttgaacccaggaggttgaggctacagtgagctgtgattgtgccactgcactccaggttgggtaatgcagcgagactgcgtctcaaaaaataaataaaataaaaaataaataaaagctccacctgtcttcc

SEQ ID NO: 350004 - DNA, 1570 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaagaacatggaaggggtgctgatggacgtggactgtgagagcgtctaccccattgtgtaggcctctaattgaggcctggcctctgctgtgggtgaatttctgtactggaagtgagtggggctccttttacgtttctttaacaccaccctctcggtttctctcccacatgtgctgctgccctacttaaggcctccccatctccgtggaagtctctctgctgtctcttttcctctctcagctccttggggctttccttagctctgcacctccttttcctttatcatctccttgggccattcttttcctttttccagaggtgatttttgtggccaatctggtttcattccctcccagacacttttctaggcatctatgcgcctctattcacatataaacaaaataggagttttcctgtgcttcccttaaatggcatatgtatctttcactcttttttttcacctagtggatctttaataccttaaaagctcaacctgggcttggtgcggtggctcatacgtgtaatcccaggcctttgggaggccaaggtgggaggatcacttgagctcaggagttccagaccattccaaagcaaaaacaaaaggattttgagatcagtgtgggcaacttagcaaaacaccatctcttaaaaaaaaaaaaaaattagccaagcttggtggtgtaagcctgtagtcccagctacttgagaggctgaggtgggaggattgtttgaacccaggaggttgaggctacagtgagctgtgattgtgccactgcactccaggttgggtaatgcagcgagactgcgtctcaaaaaataaataaaataaaaaataaataaaagctccacctgtcttcc

SEQ ID NO: 350005 - DNA, 1348 bp, Homo sapiens
ggttttttttccgaacgcccgcagcagggtcagaagggaggtggtcgccctccgtcgtggtctggcgtgtattccgagccttggtgtctggcggtttccgagcgttggtgtctggcggtttccgaccgttggtgtctggcggtttccgaccgttggtgtctggcacgcgccaccctctcttgctttggttgcgccatgccgatgtaccagacaagaagacaagaaaatgatttgaggacagcttcaatcgcggtgtgaagaagaaagcagcaaaacgaccactgaaaacaacgccggtggcaaaatatccaaagaaagggtcccaagcggtacatcgtcatagccggaaacagtcagagccaccagccaatgatcttttcaatgctgcgaaagctgccaaaagtgacatgcagggatgtccttcctgagatccgtgctatctgcattgaggaaattgggtgttggatgcaaagctacagcacgtctttcctcaccgacagctatttaaaatatattggttggactctgcatgataagcaccgagaagtccgcgtgaagtgcgtgaaggctctgaaagggctgtacggtaaccgggacctgaccgcacgcctggagctcttcactggccgcttcaaggactggatggtttccatgatcgtggacagagagtacagtgtggcagtggaggccgtcagattactgatacttatccttaaacttttctaccctgagtgcgagataagaacgatgggtggaagagagcaacgccagagcccaggtgcccagaggactttcttccagcttctgctgtccttctttgtggagagcaagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagctcccagctacttgagaggctgaggtgggaggattgtttgaacccaggaggttgaggctacagtgagctgtgattgtgccactgcactccaggttgggtaatgcagcgagactgcgtctcaaaaaataaataaaataaaaaataaataaaagctccacctgtcttcc

SEQ ID NO: 350006 - DNA, 1017 bp, Homo sapiens
gtatccttatcacactgttctacgcagaaatagaagagctgaaactggtgtatccttatcacggcgttctacacagcgactagaagagctgaaactggtgtatccttatcacggtgttgtacgcagaaatagaagagctgaggaccatcgttgcaacgatggtcctcagctaaatccccatgcacctccttccccagctccacgaccacgctgcttacttagtagacaacctgtgggactgtgcagggactcagctgaaggactgggagggtctgacaagcctgctgctggagaaggaccagagcacgtgccacatggagccagggccagggaccttccacctcctagggtgaaaccaggagagattgcttgcttcacttgtacaaggcaggaacggtggcatggggtgggggaaacttggagttggaaggtggctaatctttgattctatgtttttgatcctcctggcactccagacctgggtgatgtgcaggagagcacactgatagaaatccttgtgtccagtgcccagcaactcctgcctcagcctcccgagcagctgggactacaggcgcccgccaccacgcctggctaacttttttgtatttttagtagagacgggttttcaccgtgttggccaggatggtcttgatctcttgaccttgtgatccacctgcctcagcctcccaaagtgctgggattacaggtgtgagccaccgtgcccggccttgactaccatattttaaatttactggaggacttttttgttctcttcttttttctttttttaatagcatcccgctcttatttcagaataaaaaaaattttaaggtatgttgagtaagaatctatagagcaatgaaaatgcaagagcaatagctatgggcacgaagatcactgcagtgagctgagatcatgccactgcacttcagcctgggcgtcagagtgagaccctgtttctaaaataataataattttaaaaaatgatatttatggttgcattgggacggaagatca

SEQ ID NO: 350007 - DNA, 476 bp, Homo sapiens
gcagagcctctccatttgaaatgggagctggggccaccctccccacggccaccgccagggctccccatgcatggggtgaactccctgcccggcgccaggccatgcagcctcccctgagactcaggtcccaggaccaacccggtcaggaaggccctggggacaccgaggccagccagacagagcctggcagctcggctgtgactctgcagtgagcagccctccctgtcccagaatgagtcggatgtcttcagctgggtgatccgccgcgagttccaggagctgcgccacccggtggacgaggagaaggcccgctgcctggaggggatagggggtcacacccgtggcctggtggcctccctggacatgcagctggagcaggcccagggaacccgggagcggctggcccaagccgagtgtgtgctggaacagttcggcaatgaggaccaccatgagttcatctgggtgagtggacaggg

SEQ ID NO: 350008 - DNA, 1369 bp, Homo sapiens
tttttcctctcccagtctcctccgccctccccagcagacagcaactcaggtgggcctgggcaagaacacactccttgtctctctccccctgtgcagagccaaggatgaggcgccagtctgttgccctggaagctctgaggttgctgcatgttgaatggtccccagaccactgagtgcagctgagtcacgggcctgtctcctctgcatttttttttttttttgagatggagtgttgctgtgttgcccaggctggagtgcaatggcgtgatctcagctcactgcaacctccgcctcccaggttcacgccattctcctgcctcagcctcccgagtagctgggactacaggcgcccaccaccacgcctggctgattttttttgtatttttagtagagacggggtttcaccgtgttagccaggatggtctcgatctcctgacctcatgatccgcctgcctcggcctcccaaagtgctgggattacaggcgtgagccactgcgcccggcctccactgatgtattttttaatacaacactgtagagagagaaactggccttgaagtaactgttcttatgcagactgcagacggaaggaagctgatgtgcctggaaatgacaggaaggtggtagaggaggtggccctggggagggtgatagtaaaaatactgaactagaggtgtaggctgaaggtcattcactgcccaggcctcacaggccagaggatggagaaggaagtgcagaggggacatctcctgggttcccacctgttgtctccactggcggaagcaggtccggctgagtctctgtgccagcagttgggtgctctgcctgtgcaggagctgggggagagcaagtgcacagagagtggcgtcctgacccagcctagacagcctggggtgggtcctgatctaacccagcctctgcccagctgaatgtcctcccattgctaggagtcctggatggtgccaggggtctcctgcataggcagggagtgccgcctagaggactcactctgtaggtcccccagcactgataagccacgggtcagcatgaaccgggtttttccgctgagccgtcttccctgggagacactggattctggggctggctactcgctaggctccaccaaacgcccagaaaggctcctgcagctttgtcttacaggaccccaaaccacccaccactcataccggctgcatggagtgctgtcaggaaagaccccttcctgagaaatggtctcctggcctggacaccccttgccaggcaggcagaacttggagagttgccaccgtcagcctcaccctcttcctgacacactgcagatggtgcgtcttccaccgggccagcccctccagcagcagctgccggtggtg

SEQ ID NO: 350009 - DNA, 1047 bp, Homo sapiens
tggtgctatctcagctcactgcaagctctgcctcccaggttcacgccattctcctgcctcatttagtagagacggggtttcaccgtgttagccaggatggtctcgatctcctgacctcatgatccgcctgcctcggcctcccaaagtgctgggattacaggcgtgagccactgcgcccggcctccactgatgtattttttaatacaacactgtagagagagaaactggccttgaagtaactgttcttatgcagactgcagacggaaggaagctgatgtgcctggaaatgacaggaaggtggtagaggaggtggccctggggagggtgatagtaaaaatactgaactagaggtgtaggctgaaggtcattcactgcccaggcctcacaggccagaggatggagaaggaagtgcagaggggacatctcctgggttcccacctgttgtctccactggcggaagcaggtccggctgagtctctgtgccagcagttgggtgctctgcctgtgcaggagctgggggagagcaagtgcacagagagtggcgtcctgacccagcctagacagcctggggtgggtcctgatctaacccagcctctgcccagctgaatgtcctcccattgctaggagtcctggatggtgccaggggtctcctgcataggcagggagtgccgcctagaggactcactctgtaggtcccccagcactgataagccacgggtcagcatgaaccgggtttttccgctgagccgtcttccctgggagacactggattctggggctggctactcgctaggctccaccaaacgcccagaaaggctcctgcagctttgtcttacaggaccccaaaccacccaccactcataccggctgcatggagtgctgtcaggaaagaccccttcctgagaaatggtctcctggcctggacaccccttgccaggcaggcagaacttggagagttgccaccgtcagcctcaccctcttcctgacacactgcagatggtgcgtcttccaccgggccagcccctccagcagcagctgccggtggtg

SEQ ID NO: 350010 - DNA, 639 bp, Homo sapiens
tttttcctctcccagtctcctccgccctccccagcagacagcaactcaggtgggcctgggcaagaacacactccttgtctctctccccctgtgcagagccaaggatgaggcgccagtctgttgccctggaagctctgaggttgctgcatgttgaatggtccccagaccactgagtgcagctgagtcacgggcctgtctcctctgcatttttttttttttttgagatggagtgttgctgtgttgcccaggctggagtgcaatggcgtgatctcagctcactgcaacctccgcctcccaggttgaagcgattcttctgcctcagccttccaagtagttgggactacatgcgtgcaccaccatgcccggctaatttttgtatttttagtagagatggggtttcaccatattggccaggctggtcttgaactcctaaccccgtgatctgcctggatcacagcctctcaaagtgctgggatgacaggtgtgagtcactgcgcctggcccttctctgcacctttaatatcagtgttataattagtcactggggacagcatggcctcatcgggtttttagagttttgctcaactttatcgtcccccccataggaagcagagcctctgtgcacaggtgagtctgacg

SEQ ID NO: 350011 - DNA, 353 bp, Homo sapiens
tgccttccatccccactttcactgctgcccccaccccaccgccccaagcaagtatcagcagaccaaagaagtcttagagctttaaggggacttggagctccagaaacaaaagtaagttctaccaacaagtccaatgtagaaaactacggggaacgacgctgattggccccgtttgcattacctgacaactccaggaccaatcaccatggtgggaaggatgtggcaccataagcagcacaccctgcgtcaggtgcccgttcagccccccacaaccacacatgttaggggaggaccagcaggacctcaaaggtgaagagaggtactgttactggaggaagaagtgctaaacacac

SEQ ID NO: 350012 - DNA, 2556 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccaggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggcatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcac

SEQ ID NO: 350013 - DNA, 4985 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccaggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggcatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatttttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctac

SEQ ID NO: 350014 - DNA, 4169 bp, Homo sapiens
  misc_feature (4143)..(4143): n is a, c, g, or t
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccaggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggcatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatttttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagatattactctaaancgggatcctctagatcgctcgcgcca

SEQ ID NO: 350015 - DNA, 6905 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccaggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggcatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatttttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaacatagctttttcagtccaccctggttgctctagtagcccacagcccaatcacgttaaggttctttgctgtgggaattttaaataaaccaaaccccaaagcagaccatctgtaagctttggtctgcttgtttctgagaagggttttatttcattatactaatagtggactaataattggtaattgtgagaacttaggtatgataacattgtttgaagtaaaatatgatttgggggcagcagctttctaaataccaactctgtttgacaaatgttttgaaaattaaaatttcaagtgagcaacaccctgttaagagttttcactatagttgaggcagctactttatgaataagaccactttgggttatttaagcagaagcgtttcttttttttttttggaatggggtgggatgaggagtgagttgccagacctttgattagtttgctggtttagaaacagccagtggctgaattagtgagtaaatgaatgaaagtataaaggacttgttttttatgatagattttctgtaagaatcttaaatgttccttttcaaattagatgtgttgatgcacacatgactattctgtttttctcactgactatataacattaaaaaggggttaaagaaaacaaaactctgccttttgtgctatgaaatatttttagtccagaggttttaagctgtgtgtccattcctactctgaaaatgcatagctttgttctggatgtcatctcttgaaagtagaaaactcctatgtgtttatcacattgcagggctttcttatgtatttctggcagacttgcccaaatctttagatgggctgggttatacagcatgccctcccccaaataagggatctgaaataaatactacactattgatagtggagatatattaatttttaaaactgtaaagtaaatgtggtctctaggtttgtggtgtgtacctttgtgttaatgtgtagggaagagacagtgacttgatggttatggggagtgtatcttgatgtgtgtataggggtaagtattgctaaattatttacagcttttattcagggtgagtcatgtgatgaatggcctaatcagaaaagtgaaggagcgaagatgcaagcttgccaaatgatgaaatgaacaagattttgtatctattttttatcaggtgttgtaaaatttgtgcatggctttttgttgttgttgcttagtaactggtagaggagaaaagatgaggaaagaaactcagctttcctcacagtcttttcaaaggtacacagttggggagtaaaatctgactggcctaatcgatggaaaagaccctgtccttttcaccccatcctgcaatcctccgtgcagaggaactacactgttgtattctagtaattcactgtgatttataacaaaccggtgatgtcattctattgtgcacttttgtcaaaccatttatgtgactttaataaacatagtaaacttgctgactgcaccagaggtccattagtgatttatatattgcatgacattttctatttgagtttgacatgtagagtcatttttagtttcatggcaattgacagtcctaataactcagctaatttgaaactaacaatcttgctgtgtaaaaggaaaaaatggtgtttgtgttcagtaaatgtttgaaaaaaactaaaatgag

SEQ ID NO: 350016 - DNA, 2201 bp, Homo sapiens
gcggccgcctactactactactactgctcgaattcaagcttctaacgatgtacggggacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaacatagctttttcagtccaccctggttgctctagtagcccacagcccaatcacgttaaggttctttgctgtgggaattttaaataaaccaaaccccaaagcagaccatctgtaagctttggtctgcttgtttctgagaagggttttatttcattatactaatagtggactaataattggtaattgtgagaacttaggtatgataacattgtttgaagtaaaatatgatttgggggcagcagctttctaaataccaactctgtttgacaaatgttttgaaaattaaaatttcaagtgagcaacaccctgttaagagttttcactatagttgaggcagctactttatgaataagaccactttgggttatttaagcagaagcgtttcttttttttttttggaatggggtgggatgaggagtgagttgccagacctttgattagtttgctggtttagaaacagccagtggctgaattagtgagtaaatgaatgaaagtataaaggacttgttttttatgatagattttctgtaagaatcttaaatgttccttttcaaattagatgtgttgatgcacacatgactattctgtttttctcactgactatataacattaaaaaggggttaaagaaaacaaaactctgccttttgtgctatgaaatatttttagtccagaggttttaagctgtgtgtccattcctactctgaaaatgcatagctttgttctggatgtcatctcttgaaagtagaaaactcctatgtgtttatcacattgcagggctttcttatgtatttctggcagacttgcccaaatctttagatgggctgggttatacagcatgccctcccccaaataagggatctgaaataaatactacactattgatagtggagatatattaatttttaaaactgtaaagtaaatgtggtctctaggtttgtggtgtgtacctttgtgttaatgtgtagggaagagacagtgacttgatggttatggggagtgtatcttgatgtgtgtataggggtaagtattgctaaattatttacagcttttattcagggtgagtcatgtgatgaatggcctaatcagaaaagtgaaggagcgaagatgcaagcttgccaaatgatgaaatgaacaagattttgtatctattttttatcaggtgttgtaaaatttgtgcatggctttttgttgttgttgcttagtaactggtagaggagaaaagatgaggaaagaaactcagctttcctcacagtcttttcaaaggtacacagttggggagtaaaatctgactggcctaatcgatggaaaagaccctgtccttttcaccccatcctgcaatcctccgtgcagaggaactacactgttgtattctagtaattcactgtgatttataacaaaccggtgatgtcattctattgtgcacttttgtcaaaccatttatgtgactttaataaacatagtaaacttgctgactgcaccagaggtccattagtgatttatatattgcatgacattttctatttgagtttgacatgtagagtcatttttagtttcatggcaattgacagtcctaataactcagctaatttgaaactaacaatcttgctgtgtaaaaggaaaaaatggtgtttgtgttcagtaaatgtttgaaaaaaactaaaatgag

SEQ ID NO: 350017 - DNA, 536 bp, Homo sapiens
ctaaccccggctcaggggcagaagcaggacccgcaccgtctatagtaaaatagggtggtctccttagcccatcagcttagcgccctcactccgcccccactccctggctggagaccctcagggccgtttaggggccaggaggaggttccaggagtcaaggacattgaggacatccaggcccaaacgggatgggccaactacgcgcagcagaacctttctctaccgggcccgcgtgtgcccgccggtcggcttaggcggagacaccccacttagcgtccctcccgctcccgccctctcctcccggccctgtctgcgaaagctcgtcttcctccccgcccaagttccggcgccgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggt

SEQ ID NO: 350018 - DNA, 7127 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccaggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggcatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatttttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaacatagctttttcagtccaccctggttgctctagtagcccacagcccaatcacgttaaggttctttgctgtgggaattttaaataaaccaaaccccaaagcagaccatctgtaagctttggtctgcttgtttctgagaagggttttatttcattatactaatagtggactaataattggtaattgtgagaacttaggtatgataacattgtttgaagtaaaatatgatttgggggcagcagctttctaaataccaactctgtttgacaaatgttttgaaaattaaaatttcaagtgagcaacaccctgttaagagttttcactatagttgaggcagctactttatgaataagaccactttgggttatttaagcagaagcgtttcttttttttttttggaatggggtgggatgaggagtgagttgccagacctttgattagtttgctggtttagaaacagccagtggctgaattagtgagtaaatgaatgaaagtataaaggacttgttttttatgatagattttctgtaagaatcttaaatgttccttttcaaattagatgtgttgatgcacacatgactattctgtttttctcactgactatataacattaaaaaggggttaaagaaaacaaaactctgccttttgtgctatgaaatatttttagtccagaggttttaagctgtgtgtccattcctactctgaaaatgcatagctttgttctggatgtcatctcttgaaagtagaaaactcctatgtgtttatcacattgcagggctttcttatgtatttctggcagacttgcccaaatctttagatgggctgggttatacagcatgccctcccccaaataagggatctgaaataaatactacactattgatagtggagatatattaatttttaaaactgtaaagtaaatgtggtctctaggtttgtggtgtgtacctttgtgttaatgtgtagggaagagacagtgacttgatggttatggggagtgtatcttgatgtgtgtataggggtaagtattgctaaattatttacagcttttattcagggtgagtcatgtgatgaatggcctaatcagaaaagtgaaggagcgaagatgcaagcttgccaaatgatgaaatgaacaagattttgtatctattttttatcaggtgttgtaaaatttgtgcatggctttttgttgttgttgcttagtaactggtagaggagaaaagatgaggaaagaaactcagctttcctcacagtcttttcaaaggtacacagttggggagtaaaatctgactggcctaatcgatggaaaagaccctgtccttttcaccccatcctgcaatcctccgtgcagaggaactacactgttgtattctagtaattcactgtgatttataacaaaccggtgatgtcattctattgtgcacttttgtcaaaccatttatgtgactttaataaacatagtaaacttgctgactgcaccagaggtccattagtgatttatatattgcatgacattttctatttgagtttgacatgtagagtcatttttagtttcatggcaattgacagtcctaataactcagctaatttgaaactaacaatcttgctgtgtaaaaggaaaaaatggtgtttgtgttcagtaaatgtttgaaaaaaactaaaatgag

SEQ ID NO: 350019 - DNA, 6938 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccaggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggcatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatttttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttttatttaaacatcaaaacttaaaatatcagataatgttgcatgttttaaaaacacatttcatccctttggctacccaggaccagcactatttaagacactgcttatttataaaatgagaataatgattatatgtacatattcagacatcaaaatttaatgacattctattttgagaagggaagacaatgctgaagaaagtaaaactgttgattgaaatgctgacagggtggagaacgaatttgaagacagtggaataaactatgaactatgctaatggtaattagattttttgtttgtttagtatagtggtaaattgtgtagtatcttgctgagaatctaattctatcttgtaaaatcaatccaaatgtgtattgtgaaacacctgtataaaatcatttttgaaataagtgatctacatgcctgtttttttaaaatgtttttggtagaattgtttgaaaatatgtttagccagacccttccccaacttaatttttttttaaaaaaggaaaataggtaagaaaatgatagttctatatctcagccctctgtgaactctaggctgtctccattttgcagccactttggtcatttgatgtttactattggtatacttatgctttgaattgtaaatcttcattgatggtattacagattcaaccaaaacttctctgtcctgttcagtaattgttatataaatctggatgagctagggaggcccaggtggatgttttcattcgcaaatcatgagaaacttaagtgggttttatgcacttgatagagttggcaaaattgaactatgaagttaactatttaactcaaggaatgggcggcaaacccatcccctcgattgataaagaaggggaacatttttacattagaactgacactgaaaacatagctttttcagtccaccctggttgctctagtagcccacagcccaatcacgttaaggttctttgctgtgggaattttaaataaaccaaaccccaaagcagaccatctgtaagctttggtctgcttgtttctgagaagggttttatttcattatactaatagtggactaataattggtaattgtgagaacttaggtatgataacattgtttgaagtaaaatatgatttgggggcagcagctttctaaataccaactctgtttgacaaatgttttgaaaattaaaatttcaagtgagcaacaccctgttaagagttttcactatagttgaggcagctactttatgaataagaccactttgggttatttaagcagaagcgtttcttttttttttttggaatggggtgggatgaggagtgagttgccagacctttgattagtttgctggtttagaaacagccagtggctgaattagtgagtaaatgaatgaaagtataaaggacttgttttttatgatagattttctgtaagaatcttaaatgttccttttcaaattagatgtgttgatgcacacatgactattctgtttttctcactgactatataacattaaaaaggggttaaagaaaacaaaactctgccttttgtgctatgaaatatttttagtccagaggttttaagctgtgtgtccattcctactctgaaaatgcatagctttgttctggatgtcatctcttgaaagtagaaaactcctatgtgtttatcacattgcagggctttcttatgtatttctggcagacttgcccaaatctttagatgggctgggttatacagcatgccctcccccaaataagggatctgaaataaatactacactattgatagtggagatatattaatttttaaaactgtaaagtaaatgtggtctctaggtttgtggtgtgtacctttgtgttaatgtgtagggaagagacagtgacttgatggttatggggagtgtatcttgatgtgtgtataggggtaagtattgctaaattatttacagcttttattcagggtgagtcatgtgatgaatggcctaatcagaaaagtgaaggagcgaagatgcaagcttgccaaatgatgaaatgaacaagattttgtatctattttttatcaggtgttgtaaaatttgtgcatggctttttgttgttgttgcttagtaactggtagaggagaaaagatgaggaaagaaactcagctttcctcacagtcttttcaaaggtacacagttggggagtaaaatctgactggcctaatcgatggaaaagaccctgtccttttcaccccatcctgcaatcctccgtgcagaggaactacactgttgtattctagtaattcactgtgatttataacaaaccggtgatgtcattctattgtgcacttttgtcaaaccatttatgtgactttaataaacatagtaaacttgctgactgca

SEQ ID NO: 350020 - DNA, 4645 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccaggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggcatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcacagacagtagaattatgtgttcataaattctgcttttctttccactacccttcctcccatcccatccttccttagttctgtatttgtttttcttgcctcatggtaattgatttcagacagactttaacaaaaccacattgttttggtgtaactataaggtatttgcatattggttacctatttgtctttcttttttttaaaggaacagatataaaatgttttgtttatgtaacaagggacatttataatttcaagttgataatgttttaaacagctgcttacaaaagtatttctgttaagcctatgtcagcatgttatccatgcagcagttttgaggattttatgaagaaaaagagctaaaaaggaacattaagaggaatgggatatccaggtgttctgcacatgccaaactgctgtagatagtttacactcttccattatttatacggagtgatgcagcacattttagcattcaggaggatttttaaaaaatagctgcagattaatctggaaaatgtgctaatttaataatagttacaaatttataaatttaaatccatttgaaattgttgcattatgctgggtagtatatacaaaatggttatcatcttaaaccaacttttcagagaatcttgatggactctgcctttaggcttgaattcttcaaagtctattttaatgaaatttatctaaattgcagcagtctatttgattcagctcatagacatgtaaaaattatgaatgctgttttcttatgaaacaaattgtcacagtgtagttatacattctatttttgtccccttttccctttttctcctgtatcttttaaaatttggaaactacttttccagaaggcattatttatgcctccctaataaggtattttacttatgacagatgaaaaggaaccaggatatttttgaattttttcactttcttagtctgtgacaagaagtagaaatatcactagtgtggtataggaacttacatgttttttatgatgaaaataattctcaatgccacttgaaaggtaattgtgtctgagagctgcaaatttttcaaccacaaaatgtcacttattcctacaggctatacagaggtctttatggtttttttgttttgttttaatggcaacattgtaactgtcaaactaaaagggtattctgtgattatcttttaagcattacagaaattcaagtgaaagttatatgcttatttctattgatgttaaaaatgataatgaaagcaaaattagctgtatctgtaattttctctctagtgccaaatgaatgccttagctactcatagtgcatggtactgtaagtgaagacctgtagctttttttttttctttaatgaaaagcattataatgatgtagcagcatcagatataaacttaaaaaaaaaggtttcaattaacattttatatatggataatgctttgtaaagtgtaagagaaaggttgcagttggatcagtataaaacaatgaccaagccaaaatcagcaccctagggccttaaataaaatagagataccccacaaaatgaaatattttgaaggatgggaggggacagaaggggggactatcccccaaggatgcaagatactttttacagttgctatcattatactttgtcttcttgcttcagttaggaaggttttgatggtaaattctgtcatggtaatagatacctattttcctaacctgagattttacaaggaaggtttttaggttggcttaaatggaggtatttatttgagtgagccctaatttgaaaattaccagacttgatcctcctggtatgaatcaaggaaatactgtaccttgctcttagcaactctcagtggcctgaaagagaaaatgcacttcttcaaggtgagtgaatcatgctttttccacagttcagatcagaccctttatttttcaaactacaaggcctgcttattggacagtctaaggaatagctttgatacttggtattcagttggttccattattaatgtatattatttagtccctgtatgtactatatctcccagatagttgccatggcctttagctgtgtgccacatttgggggatttatcaca

SEQ ID NO: 350021 - DNA, 2334 bp, Homo sapiens
cgctcttgcgggagcgttccgcatcgccccgggggcccctacgcgaggatctccggggccgttggcagcgcctggcacttctgagctcggcggacgagagcctgcaggtttcctccagtcagggacggcgaagggcggaaagcgcaggaggaggcagtgttaggccttaggccgggtgggccgggtcaggagagacgcgcccatctttcgccatccggggtgcgcgaggtcctctcgggacccggccggcgacccgtagctcgggcacgcgcctgtcgcatcccgcaggaaggaggggtccggcctgaggcccggggcggcgtccgccatggagatcccctcggtccaggccggcgcctgggacctggcgggcggccctgaccgccttcctccctgcgcgggctgggtcgcggacgtgcccttcgcggcactcggcctcctctgcgtctccgccttccctgggccgcactgctgcctgggcgcggcggcggcgacggcgccctgttgaatgggctgtgagggcccaggtttaaagcgctggcgaacgcggcctccgggggcgcacggcagctgcagcggtggcgaccaaacgggtgttggagttggcggcggcatggagggcctggctggctatgtatacaaggcggccagcgagggcaaggtgctgactctggccgccttgcttctcaaccggtctgaaagcgacatccgctatctgcttggctatgtcagccagcagggagggcagcgctccacgcccctcatcatcgcagcccgcaatggacacgcaaaggtggtacgcttgctcttagaacattaccgggtgcagactcagcagactggcaccgtccgcttcgacgggtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaagtgtgcatctctaccaaaacacagtgcagcgaagaagatcagtgcaaaattaacaagcagatctacaacctgattcaccttgatcccagaactcgtgaaggtttcaccttgctgcatctggctgtcaactccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaagtgactggatatgtaaagtcgtttaatgtggtgctaaaaagtaaaggacttttaatcac

SEQ ID NO: 350022 - DNA, 2271 bp, Homo sapiens
cagcaccaaccagaacttcacaggaaatttattattttttgaaagggctgagggagactttacaagggtctgaagctggtaactagaaagaaagataaataaaatacgaagccagtatgttgtggcaaaattcgagaaaacacactgaaaaaaatctttacagtttaaaactgcttcactttatacataattacaaatgaatatacagcatctgggttttaacccgtcttttttatttaataggatttagcacacaaatgtccatagagcatttggaaacaagcaatgagagcagaggtatccggtgtatcccaaccaccctcctgcggatccccacgcctcccctgcgcatcccatgcgggcagcagcacacaggagaccacaggctaagcctgaaccacaggcagactcaccaggcacgccccatggcctgtgctcatgccctcaggtggtgacgaaaggtaggggaagctcaggccggggaaggtgtggggggtgagtgcttcctgcagaagcccctccggactgcagcacaggtggtcccacctggttgtagggcaggtcactcacttcggtggcaggggacacagccagtggggggttgcacgcctttaacccttagtgagatggagaagtaattcatggcctatcaatcttttgacaattaaattagatgagtacttggaaagatgcctttattttcccttcctcccccccgcctcccttttatggcagcattaaaacacttttcattttaaagcctggccagcaggcagtagattccaaggctctggttaactaggaatgctttgctacattgaaaggaaagttcaaaaccaagcccaaactccctgccctcttctttgtctctgaggatggacgagagcgacggggctggctgggacgcatccataggtggctgcgcacctagacggtcctgctgaaggaaggcaaggcacacagatctccagcagccgctgccccaattccatccacagggttatttctaggctcccacattccaaggacatccaaaacgcagagggtgcacatcgttctgcagtgtctggggtcacctcacagccaccctctttgtgaccacttgaagcccattcaccaggactgtctttctaaactccctcccagggcctgcctggctgtcctctgggcacagctgggccaccatcattagagtaaacctcaactccaatgcaaatactaaaatccttgggaagacctggctacagaaaaagagccctagaaacaaaaatgatgaaatagaaagcacttctgtggacagcaacttctggatcaagttctggcctctaaggttatagtcccaccctctactaaggcagggtctatctagttcaacccttgcatgcactaacacctcccctcccacatcaagaaacaacgccaaaggtctcaaaactttgtgctcacgactaatactgaggcctcaggaaggtaacaaatacgggagaaaatgagcaaaggggcgactctgaatagtattaccctgagacacagaaggggaaaaaagttaagattcgtacctttccaaaaaaaccttggtaaggattcttccccccagatagctctcacgggggtagagggaatactggcaaaggttgaaagtggcagtttgcatgtttttaaccctctccattttctaagaagaaaacacagtcaatacatttgattgtcttgaaaatgaagccaaccgatgagagcatttaaagtgcacatgtcacctaacgacaacgactgagatgactggaattgagagaagacgcagtctccttccaggaagctcactcgattctggaaatctgggggctctggataggaactccatctttcccccaaaacttaagcacagtttcaggcacgtgatttctttagcttgatggagaacatggtgtcccggcgtggaaacagtatggggaattcagtccgagtcaccccaaaaaaacaaccccttctcatgtgatagaaaccaagacaggccattagatccagcaactagagcactgtcaaggccatgagcaaaagcacaggcagccaccatcccaggtaaatccccaggacaggaacaaatccccctgaggacaacttccaaggggggaagagagatgacaaaggtatgtaagcacagttcttggtaagcggttctgttgctgcactgcagactgtattcctggatgaagttgggtggtttgagggaattccgggcactactttgattttaaacttgtccaaccagaa

SEQ ID NO: 350023 - DNA, 378 bp, Homo sapiens
cagcaccaaccagaacttcacaggaaatttattattttttgaaagggctgagggagactttacaagggtctgaagctggtaactagaaagaaagataaataaaatacgaagccagtatgttgtggcaaaattcgagaaaacacactgaaaaaaatctttacagtttaaaactgcttcactttatacataattacaaatgaatatacagcatctgggttttaacccgtcttttttatttaataggatttagcacacaaatgtccatagagcatttggaaacaagcaatgagagcagaggtatccggtgtatcccaaccaccctcctgcggatccccacgcctcccctagcgatgatggggatcctgctagattctcgca

SEQ ID NO: 350024 - DNA, 915 bp, Homo sapiens
ggaccctttagaattcgtcgtggtcgtggaattcgtcgtatggtgacgaaaggtaggggaagctcaggccggggaaggtgtggggggtgagtgcttcctgcagaagcccctccggactgcagcacaggtggtcccacctggttgtagggcaggtcactcacttcggtggcaggggacacagccagtggggggttgcacgccttctttccaaaaaaaccttggtaaggattcttccccccagatagctctcacgggggtagagggaatactggcaaaggttgaaagtggcagtttgcatgtttttaaccctctccattttctaagaagaaaacacagtcaatacatttgattgtcttgaaaatgaagccaaccgatgagagcatttaaagtgcacatgtcacctaacgacaacgactgagatgactggaattgagagaagacgcagtctccttccaggaagctcactcgattctggaaatctgggggctctggataggaactccatctttcccccaaaacttaagcacagtttcaggcacgtgatttctttagcttgatggagaacatggtgtcccggcgtggaaacagtatggggaattcagtccgagtcaccccaaaaaaacaaccccttctcatgtgatagaaaccaagacaggccattagatccagcaactagagcactgtcaaggccatgagcaaaagcacaggcagccaccatcccaggtaaatccccaggacaggaacaaatccccctgaggacaacttccaaggggggaagagagatgacaaaggtatgtaagcacagttcttggtaagcggttctgttgctgcactgcagactgtattcctggatgaagttgggtggtttgagggaattccgggcactactttgattttaaacttgtccaaccagaa

SEQ ID NO: 350025 - DNA, 2221 bp, Homo sapiens
cagcaccaaccagaacttcacaggaaatttattattttttgaaagggctgagggagactttacaagggtctgaagctggtaactagaaagaaagataaataaaatacgaagccagtatgttgtggcaaaattcgagaaaacacactgaaaaaaatctttacagtttaaaactgcttcactttatacataattacaaatgaatatacagcatctgggttttaacccgtcttttttatttaataggatttagcacacaaatgtccatagagcatttggaaacaagcaatgagagcagaggtatccggtgtatcccaaccaccctcctgcggatccccacgcctcccctgcgcatcccatgcgggcagcagcacacaggagaccacaggctaagcctgaaccacaggcagactcaccaggcacgccccatggcctgtgctcatgccctcaggtggtgacgaaaggtaggggaagctcaggccggggaaggtgtggggggtgagtgcttcctgcagaagcccctccggactgcagcacaggtggtcccacctggttgtagggcaggtcactcacttcggtggcaggggacacagccagtggggggttgcacgccttaattaaattagatgagtacttggaaagatgcctttattttcccttcctcccccccgcctcccttttatggcagcattaaaacacttttcattttaaagcctggccagcaggcagtagattccaaggctctggttaactaggaatgctttgctacattgaaaggaaagttcaaaaccaagcccaaactccctgccctcttctttgtctctgaggatggacgagagcgacggggctggctgggacgcatccataggtggctgcgcacctagacggtcctgctgaaggaaggcaaggcacacagatctccagcagccgctgccccaattccatccacagggttatttctaggctcccacattccaaggacatccaaaacgcagagggtgcacatcgttctgcagtgtctggggtcacctcacagccaccctctttgtgaccacttgaagcccattcaccaggactgtctttctaaactccctcccagggcctgcctggctgtcctctgggcacagctgggccaccatcattagagtaaacctcaactccaatgcaaatactaaaatccttgggaagacctggctacagaaaaagagccctagaaacaaaaatgatgaaatagaaagcacttctgtggacagcaacttctggatcaagttctggcctctaaggttatagtcccaccctctactaaggcagggtctatctagttcaacccttgcatgcactaacacctcccctcccacatcaagaaacaacgccaaaggtctcaaaactttgtgctcacgactaatactgaggcctcaggaaggtaacaaatacgggagaaaatgagcaaaggggcgactctgaatagtattaccctgagacacagaaggggaaaaaagttaagattcgtacctttccaaaaaaaccttggtaaggattcttccccccagatagctctcacgggggtagagggaatactggcaaaggttgaaagtggcagtttgcatgtttttaaccctctccattttctaagaagaaaacacagtcaatacatttgattgtcttgaaaatgaagccaaccgatgagagcatttaaagtgcacatgtcacctaacgacaacgactgagatgactggaattgagagaagacgcagtctccttccaggaagctcactcgattctggaaatctgggggctctggataggaactccatctttcccccaaaacttaagcacagtttcaggcacgtgatttctttagcttgatggagaacatggtgtcccggcgtggaaacagtatggggaattcagtccgagtcaccccaaaaaaacaaccccttctcatgtgatagaaaccaagacaggccattagatccagcaactagagcactgtcaaggccatgagcaaaagcacaggcagccaccatcccaggtaaatccccaggacaggaacaaatccccctgaggacaacttccaaggggggaagagagatgacaaaggtatgtaagcacagttcttggtaagcggttctgttgctgcactgcagactgtattcctggatgaagttgggtggtttgagggaattccgggcactactttgattttaaacttgtccaaccagaa

SEQ ID NO: 350026 - DNA, 1172 bp, Homo sapiens
cagcaccaaccagaacttcacaggaaatttattattttttgaaagggctgagggagactttacaagggtctgaagctggtaactagaaagaaagataaataaaatacgaagccagtatgttgtggcaaaattcgagaaaacacactgaaaaaaatctttacagtttaaaactgcttcactttatacataattacaaatgaatatacagcatctgggttttaacccgtcttttttatttaataggatttagcacacaaatgtccatagagcatttggaaacaagcaatgagagcagaggtatccggtgtatcccaaccaccctcctgcggatccccacgcctcccctgcgcatcccatgcgggcagcagcacacaggagaccacaggctaagcctgaaccacaggcagactcaccaggcacgccccatggcctgtgctcatgccctcaggtggtgacgaaaggtaggggaagctcaggccggggaaggtgtggggggtgagtgcttcctgcagaagcccctccggactgcagcacaggtggtcccacctggttgtagggcaggtcactcacttcggtggcaggggacacagccagtggggggttgcacgcctttaacccttagtgagatggagaagtaattcatggcctatcaatcttttgacaattaaattagatgagtacttggaaagatgcctttattttcccttcctcccccccgcctcccttttatggcagcattaaaacacttttcattttaaagcctggccagcaggcagtagattccaaggctctggttaactaggaatgctttgctacattgaaaggaaagttcaaaaccaagcccaaactccctgccctcttctttgtctctgaggatggacgagagcgacggggctggctgggacgcatccataggtggctgcgcacctagacggtcctgctgaaggaaggcaaggcacacagatctccagcagccgctgccccaattccatccacagggttatttctaggctcccacattccaaggacatccaaaacgcagagggtgcacatcgttctgcagtgtctggggtcacctcacagccaccctctttgtgaccatgaggtctcatcatttagcccccacttacagtgagaacatgtggttatgtgtttcctgccatcgacctatg

SEQ ID NO: 350027 - DNA, 2269 bp, Homo sapiens
tttttttttcgcatctttgaaaggatttattgatcacttttgcgcactcgtgctgaggacagggcaggtccagcctggggcctgctccccactgcagcatttccaggcccccagagtgggccgaagggggacatgggcgtgtctttccacattaagtaccaggaaattccgtgagtataaggccttatcttaagtaggacgtgcccaggctgcagcagaacccctgggggtgggggatgaggatttagcacacaaatgtccatagagcatttggaaacaagcaatgagagcagaggtatccggtgtatcccaaccaccctcctgcggatccccacgcctcccctgcgcatcccatgcgggcagcagcacacaggagaccacaggctaagcctgaaccacaggcagactcaccaggcacgccccatggcctgtgctcatgccctcaggtggtgacgaaaggtaggggaagctcaggccggggaaggtgtggggggtgagtgcttcctgcagaagcccctccggactgcagcacaggtggtcccacctggttgtagggcaggtcactcacttcggtggcaggggacacagccagtggggggttgcacgcctttaacccttagtgagatggagaagtaattcatggcctatcaatcttttgacaattaaattagatgagtacttggaaagatgcctttattttcccttcctcccccccgcctcccttttatggcagcattaaaacacttttcattttaaagcctggccagcaggcagtagattccaaggctctggttaactaggaatgctttgctacattgaaaggaaagttcaaaaccaagcccaaactccctgccctcttctttgtctctgaggatggacgagagcgacggggctggctgggacgcatccataggtggctgcgcacctagacggtcctgctgaaggaaggcaaggcacacagatctccagcagccgctgccccaattccatccacagggttatttctaggctcccacattccaaggacatccaaaacgcagagggtgcacatcgttctgcagtgtctggggtcacctcacagccaccctctttgtgaccacttgaagcccattcaccaggactgtctttctaaactccctcccagggcctgcctggctgtcctctgggcacagctgggccaccatcattagagtaaacctcaactccaatgcaaatactaaaatccttgggaagacctggctacagaaaaagagccctagaaacaaaaatgatgaaatagaaagcacttctgtggacagcaacttctggatcaagttctggcctctaaggttatagtcccaccctctactaaggcagggtctatctagttcaacccttgcatgcactaacacctcccctcccacatcaagaaacaacgccaaaggtctcaaaactttgtgctcacgactaatactgaggcctcaggaaggtaacaaatacgggagaaaatgagcaaaggggcgactctgaatagtattaccctgagacacagaaggggaaaaaagttaagattcgtacctttccaaaaaaaccttggtaaggattcttccccccagatagctctcacgggggtagagggaatactggcaaaggttgaaagtggcagtttgcatgtttttaaccctctccattttctaagaagaaaacacagtcaatacatttgattgtcttgaaaatgaagccaaccgatgagagcatttaaagtgcacatgtcacctaacgacaacgactgagatgactggaattgagagaagacgcagtctccttccaggaagctcactcgattctggaaatctgggggctctggataggaactccatctttcccccaaaacttaagcacagtttcaggcacgtgatttctttagcttgatggagaacatggtgtcccggcgtggaaacagtatggggaattcagtccgagtcaccccaaaaaaacaaccccttctcatgtgatagaaaccaagacaggccattagatccagcaactagagcactgtcaaggccatgagcaaaagcacaggcagccaccatcccaggtaaatccccaggacaggaacaaatccccctgaggacaacttccaaggggggaagagagatgacaaaggtatgtaagcacagttcttggtaagcggttctgttgctgcactgcagactgtattcctggatgaagttgggtggtttgagggaattccgggcactactttgattttaaacttgtccaaccagaa

SEQ ID NO: 350028 - DNA, 1010 bp, Homo sapiens
cagcaccaaccagaacttcacaggaaatttattattttttgaaagggctgagggagactttacaagggtctgaagctggtaactagaaagaaagataaataaaatacgaagccagtatgttgtggcaaaattcgagaaaacacactgaaaaaaatctttacagtttaaaactgcttcactttatacataattacaaatgaatatacagcatctgggttttaacccgtcttttttatttaataggatttagcacacaaatgtccatagagcatttggaaacaagcaatgagagcagaggtatccggtgtatcccaaccaccctcctgcggatccccacgcctcccctgcgcatcccatgcgggcagcagcacacaggagaccacaggctaagcctgaaccacaggcagactcaccaggcacgccccatggcctgtgctcatgccctcaggtggtgacgaaaggacctggggccgcccaggaggactggacgctgaggagcagtgggcgtccagtgtaagagacttgtgcacgcggggacagcaggagaggtgggctggccaggatcaggaggcagctgcctcagcagagaggaagagggtcagcagaagatctcttcaccctctgctgatacttctgacgtgggaccatctggaaatgtgaaaaccaagaatgaaaaaaattcagaaaaactgctcctttcattgaacttcctccccatcccaaagtcttctgtaatgcaaacaggcgactggggcttatgggcaattaactcttctgcgcaccggggtttctgaacaaatttggttaataaggttcttaagtgatatccttcactgcctaatgctccctttaacttttaaataatcactagaatttatgaagaggccaggaaaatgtactttttctttaacctcccacacagaaaggagagatcaatcctaaagagaaggattcaggggaaaaagtggtacatgaacagggaggcatttagtggaattcagccgcaggct

SEQ ID NO: 350029 - DNA, 2179 bp, Homo sapiens
ggccccgtcgtacgtgtgcgccagtgtctctgtggcgtctgccgttcggcctctctgtccttctatttctagtgttcagcagttcgttcttctcttctcttcgcctcttgccgtcggctgcgtgttctccgctgtgggtcgtggcgtggtgtcgttgtacctgcttgctgctttgtgtccgcgctcgcctcccggtctgtttccctgtgcgttctgctccgcttgctccgcggcatattggcgcttcttgtgtccttcgtgcctggttgcatctggtcttgttggccttgtgtcttgctttgtctggctgtggtgtctgctgattgagtttgttgtgctgcgcgcgtgtcggtggctgtcgttggggtggtgactgttctggggcatgctgtgcccgagcgcgcgttcgtcgtatggtggtcttcgtgttgcttccggatgttgtctcgtcttggttcgttgtgtccggtgtgtcgcttcggagtgtgttcgtttgctcactgcgctttacgtgcgcggttgagttgtagtgtgtgctgtcgtcgcctgctgctatgctcttgcgtcgtgtctcggcttatgtgtcgtttgccatctatgcctttattttcccttcctcccccccgcctcccttttatggcagcattaaaacacttttcattttaaagcctggccagcaggcagtagattccaaggctctggttaactaggaatgctttgctacattgaaaggaaagttcaaaaccaagcccaaactccctgccctcttctttgtctctgaggatggacgagagcgacggggctggctgggacgcatccataggtggctgcgcacctagacggtcctgctgaaggaaggcaaggcacacagatctccagcagccgctgccccaattccatccacagggttatttctaggctcccacattccaaggacatccaaaacgcagagggtgcacatcgttctgcagtgtctggggtcacctcacagccaccctctttgtgaccacttgaagcccattcaccaggactgtctttctaaactccctcccagggcctgcctggctgtcctctgggcacagctgggccaccatcattagagtaaacctcaactccaatgcaaatactaaaatccttgggaagacctggctacagaaaaagagccctagaaacaaaaatgatgaaatagaaagcacttctgtggacagcaacttctggatcaagttctggcctctaaggttatagtcccaccctctactaaggcagggtctatctagttcaacccttgcatgcactaacacctcccctcccacatcaagaaacaacgccaaaggtctcaaaactttgtgctcacgactaatactgaggcctcaggaaggtaacaaatacgggagaaaatgagcaaaggggcgactctgaatagtattaccctgagacacagaaggggaaaaaagttaagattcgtacctttccaaaaaaaccttggtaaggattcttccccccagatagctctcacgggggtagagggaatactggcaaaggttgaaagtggcagtttgcatgtttttaaccctctccattttctaagaagaaaacacagtcaatacatttgattgtcttgaaaatgaagccaaccgatgagagcatttaaagtgcacatgtcacctaacgacaacgactgagatgactggaattgagagaagacgcagtctccttccaggaagctcactcgattctggaaatctgggggctctggataggaactccatctttcccccaaaacttaagcacagtttcaggcacgtgatttctttagcttgatggagaacatggtgtcccggcgtggaaacagtatggggaattcagtccgagtcaccccaaaaaaacaaccccttctcatgtgatagaaaccaagacaggccattagatccagcaactagagcactgtcaaggccatgagcaaaagcacaggcagccaccatcccaggtaaatccccaggacaggaacaaatccccctgaggacaacttccaaggggggaagagagatgacaaaggtatgtaagcacagttcttggtaagcggttctgttgctgcactgcagactgtattcctggatgaagttgggtggtttgagggaattccgggcactactttgattttaaacttgtccaaccagaa

SEQ ID NO: 350030 - DNA, 2690 bp, Homo sapiens
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgtt

SEQ ID NO: 350031 - DNA, 2765 bp, Homo sapiens
  misc_feature (2699)..(2699): n is a, c, g, or t
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgtttaacaaaanaaacaacacacacaaaccaaaaacaaaacaaatacaacacaaaaccacaacaaccccagagagggg

SEQ ID NO: 350032 - DNA, 2478 bp, Homo sapiens
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgtt

SEQ ID NO: 350033 - DNA, 2616 bp, Homo sapiens
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgtt

SEQ ID NO: 350034 - DNA, 1007 bp, Homo sapiens
  misc_feature (69)..(69): n is a, c, g, or t
aacttacaaacaaaaataccgtaataataaacccaaacaaagaccctcagcttgctgccacgtcctctntgcgtttcaaacgcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgtt

SEQ ID NO: 350035 - DNA, 1174 bp, Homo sapiens
gagatcacgccactgaactccagcctgggtgacagagcgagactctgtctcaaaaaaaaaaaaattggccgggcgcggtggctcacgcctgtaatcccagcactttgggaggccgaggcgggcggatcacgaggtcaggagatcgagaacatcccggctaaaacggtgaaaccccgttccataccattccatcccgttccattccattccattccattgcattccattctctctccactcccgggagtggaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgtt

SEQ ID NO: 350036 - DNA, 1765 bp, Homo sapiens
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaagtatgtcctctttttgtttgcttttagatgatttgaattaaatactgaatagatagagatgaatatttataaaatatgtacatgatataaagcaagggctggcaaattatgtggtcctactacccaagtttaagaagtagaactgctccattatctttgaagccttctgtgtgcccctcctttagggcacccatatgtattagtttatccaggaccacaactattgttctggaagcaaggagctcaaaaata

SEQ ID NO: 350037 - DNA, 1166 bp, Homo sapiens
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggagtggtgaacagacccaaggattaaattgggatcccttctggagatacaggatggtccctcatcaccgccacactggacatcttggttttcaa

SEQ ID NO: 350038 - DNA, 278 bp, Homo sapiens
ctcggtacccagcgctgagccataccattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgtt

SEQ ID NO: 350039 - DNA, 1011 bp, Homo sapiens
  misc_feature (858)..(859): n is a, c, g, or t
  misc_feature (947)..(947): n is a, c, g, or t
  misc_feature (986)..(986): n is a, c, g, or t
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaagaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtgtgcatggctttaannctctcttacactgttctgatgctctgctgaattacaggagctgtgtactctgggtttcatgtgtcaggaggggctgcacagcagtctngtagatccatgtgcaagctcttactgagggcactgatanacatggatgactaagatcactgtct

SEQ ID NO: 350040 - DNA, 2818 bp, Homo sapiens
ggatcctaggatgcttacatgcaatgatgaacccgaaaacacttgtaaagtgctacgtaaatattgatcacgaagaaggaagtcctcttcccgcctggagactgtgtggggtatggcggcgtggtggagagaatgtggtgtcttgttccaccctcctggagaggggagggcctggcctggaccgcagaggaatcgagtgactgcccctaaaatctcctagaaccgatcccgtggacccgtccctcccgagggtcccgcccctcccgtggtccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggtaactgcaacgagccggggaggctggggcgccctggggccggatgcgcggatttcccggccagcccccgtttcctgtgttctgcagcgttgacttgagcacaagacagtgacagtggagagtctaaggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacattgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgtt

SEQ ID NO: 350041 - DNA, 1837 bp, Homo sapiens
  misc_feature (7)..(7): n is a, c, g, or t
  misc_feature (9)..(9): n is a, c, g, or t
  misc_feature (19)..(19): n is a, c, g, or t
  misc_feature (22)..(22): n is a, c, g, or t
tcgtcantntcggcagganatngtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattagataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgtt

SEQ ID NO: 350042 - DNA, 793 bp, Homo sapiens
attgagagtaatttcagactgaattaaaggcattaagcataattttagaacctaagtgcacattgattttaaaaagtaactaaaagctgggtgtggtggctcatgcctgtaatcccagcactttgtgaccaagggtggtggttattgtcttgcttgaataattgacattcaaagttcctaacacagttggaatttctgcgttccttatgctgcagtctacttagcttcttccgtccctgctatttttggtttccccttttattcttagccacattctaatttctagaataagtattttcttaggtttctatttaagaactcaaacatattcttccattgaaaatcacctaataagctgacagagaaacccgttaatctggtacataaacatctagtttctgcttattttcaatgacttgaaactaaatatccagttccatttttggtcatctcttgctatcatagttcttccaataaatttgttataattaccaccaactggtccttactgtacttaaaagcggaaatgtctttccactgatttctacttaggacttactccacctttaatatgacatatgacttttacctaatggatgtatactgtccctctagcaaattaaaattttctattaagtacttataaatagtcattgcttattaattacttctagaattttgtggggaaatgtatttaattaagtttgccagaaaataccttttggaaaaataattatgatttcaggtttacttctatatatagaacagtctaccacaattcttcaaaaaaaaa

SEQ ID NO: 350043 - DNA, 1776 bp, Homo sapiens
ggagtagagtagggcaggagaaactgggccaggctgcacttagctcaaggggcctcgaggactctctgcgtctctggagacaagggcactacacgcacttcagaatgaagagttgcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350044 - DNA, 1199 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350045 - DNA, 1382 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagctaccttaggaattcctatgatgcaaactagaacccgacttgcagatggaagcgagccacacatgggtttacatcattgcgcggataccattaagaggttgaaacacatcatattggccccagaggtgacccaaattaaaggatgtccaaatgaccgcgaatatcccaacacagcctgtcactctctacggtacccacttaatgaaacctgagattgaaccttgttactcctaaggcaataattacgggtcaccagtaagac

SEQ ID NO: 350046 - DNA, 341 bp, Homo sapiens
ctcacagactggccgtgcagaggatgaggtgggagagattgagtaggccaggccctggggagccaggagtccacttccctcaagaggctactgagtgccccccgctctccctccagatgacagcctctcaccctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggtgagggatggggagatgggaccccaagaaccccaactaggacccgtactcagggtcctgagc

SEQ ID NO: 350047 - DNA, 1771 bp, Homo sapiens
cacggacctggtgtgggagcgagaggaggtggcttgattgccgggcgtctgttccgagggaggagggtgttgccatctccctcacatgcccttatcacccctttctcaggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350048 - DNA, 2594 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaaaaaaaaa

SEQ ID NO: 350049 - DNA, 1368 bp, Homo sapiens
ctagtagaggcggtgtgaatcggacgagggcattcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350050 - DNA, 1972 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350051 - DNA, 1272 bp, Homo sapiens
gatctagaggatcgcctgctgctccctcttcacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350052 - DNA, 2696 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcaggtgagccaagcctgctgggtggggcgaggccagacgtcactgtcaataccctgaggcatctcttcctttctagtgggccggtcaggctggggcctgggtcagagcggtgctgcccgtgccgcctgaagagctgcagccagaacaggtggctgagctgtggggccggggtgaccggatcgaatctctcagcgaccaggctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaaaaaaaaa

SEQ ID NO: 350053 - DNA, 2204 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccaggtaataagggattttgtggcctgaagattggctaaagacatcccccaaccccagttggtctttatctcatgcctaaactggcctgctccttccactgttcagttagtgctcctccccccattcatcatgtcacccaagaccaaaacctgggagtcatatcccaaccccttgtatcaagccagtcactaagtcctgctgactcttctcctctccatccctatcaccccctcccccactttataaaaacttttaattttgaaattcttatagattcataggaaattgcaaagatagtatagcgaggcccttcacccagcttcccccagtggttgcatcctatgtaattatagcacagtatcaaaaccaggaaattcacattggttcaatgtgtgtgtgtagttttataccattttatcacatttcctaccacctctttacttacctggactattataacagcctccagctttgtcccctccatcctattccttagaaaaaaatccatggctccatggtactatgtgcttgcctgtgttataggtcaccatgtgtgatctgtaatgtcacctgagctacttgaattgctcaacaaatatttattcaacattatgggcgcaggcttgttctgggccctagggatgcagtggtaaataaaagagaagtccctaatgttatgtagcttatattctagtttgtaagatagctgatacatacatacaaatatatatgtcaggtaataaggcaggggaaaggattagaggatgtccggggcctagtttcaatagtggccgaagaagtcctcctggaaaagtcaccattcaattagagactgaaggaagtgaaggagggagttgtgctctgggtggaagaaccccccagggagaaggtctggcacctgcagaggccctgaagcacgtgtgagcaat

SEQ ID NO: 350054 - DNA, 1547 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttcttggtctctatgatgcaaatgagacgtcccgggatggaggcgcactggttatcgcggatctttgggtggacaccctattggccgggggcccagtgggggtcctggccggttcccaaaggcgggtccaacggctttgaaacggtagactgccccgagaaataggggccgaactcgccaaacggggcggcacaattcttctggggggcccgccctctcccaggaaggggaagacgcaccactcgaaaaaacaccacttggtggtgcg

SEQ ID NO: 350055 - DNA, 1540 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagctaccttaggaattcctatgatgcaaactagaacccgacttgcagatggaagcgagccacacatgggtttacatcattgcgcggataccattaagaggttgaaacacatcatattggccccagaggtgacccaaattaaaggatgtccaaatgaccgcgaatatcccaacacagcctgtcactctctacggtacccacttaatgaaacctgagattgaaccttgttactcctaaggcaataattacgggtcaccagtaagac

SEQ ID NO: 350056 - DNA, 702 bp, Homo sapiens
  misc_feature (2)..(2): n is a, c, g, or t
  misc_feature (8)..(8): n is a, c, g, or t
tngactcnagaggatccccgacggatagcggatctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaaaaaaaaa

SEQ ID NO: 350057 - DNA, 768 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350058 - DNA, 441 bp, Homo sapiens
cccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctt

SEQ ID NO: 350059 - DNA, 2222 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350060 - DNA, 2885 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaaaaaaaaa

SEQ ID NO: 350061 - DNA, 1245 bp, Homo sapiens
agcggtgtgagccaccgcacctggcctacattatcactactattttattactatccaccttgactattgctacagcttccttattgggcttttcaccaccagtcttgcctcccttttctgcttctttttctaactgctgtttgtacccagatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccaggtaataagggattttgtggcctgaagattggctaaagacatcccccaaccccagttggtctttatctcatgcctaaactggcctgctccttccactgttcagttagtgctcctccccccattcatcatgtcacccaagaccaaaacctgggagtcatatcccaaccccttgtatcaagccagtcactaagtcctgctgactcttctcctctccatccctatcaccccctcccccactttataaaaacttttaattttgaaattcttatagattcataggaaattgcaaagatagtatagcgaggcccttcacccagcttcccccagtggttgcatcctatgtaattatagcacagtatcaaaaccaggaaattcacattggttcaatgtgtgtgtgtagttttataccattttatcacatttcctaccacctctttacttacctggactattataacagcctccagctttgtcccctccatcctattccttagaaaaaaatccatggctccatggtactatgtgcttgcctgtgttataggtcaccatgtgtgatctgtaatgtcacctgagctacttgaattgctcaacaaatatttattcaacattatgggcgcaggcttgttctgggccctagggatgcagtggtaaataaaagagaagtccctaatgttatgtagcttatattctagtttgtaagatagctgatacatacatacaaatatatatgtcaggtaataaggcaggggaaaggattagaggatgtccggggcctagtttcaatagtggccgaagaagtcctcctggaaaagtcaccattcaattagagactgaaggaagtgaaggagggagttgtgctctgggtggaagaaccccccagggagaaggtctggcacctgcagaggccctgaagcacgtgtgagcaat

SEQ ID NO: 350062 - DNA, 2654 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaaaaaaaaa

SEQ ID NO: 350063 - DNA, 2727 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcaggtgagccaagcctgctgggtggggcgaggccagacgtcactgtcaataccctgaggcatctcttcctttctagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaaaaaaaaa

SEQ ID NO: 350064 - DNA, 2068 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350065 - DNA, 2126 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccaggaactcctcggtccagagaccaagtggtggccttggaaagcagatgtcaggctttggtgtgcctgtgaccacctcattgctcccatattatcccccatttttagtagagacggggttttagtagagacttggcctcccagaacccccttcctctgctcctccatgaatgacaattccaggcctcccctacctcatgtcctctcatttgggggattgctccgtgctgtccctttctctcaaggccgaagttgggaagtgagaaaccatgtttttaacttgtggctgcttttgctgctgctgctcctccgtatctggctgtatgggtggagaacccaccccctgcccaccacaggggtctccttccaggccactcaggacatttttagcttctctcctccccatgttcccttttttctctaaagtcccctgacatcagccctcccaactcctaagagggactacccatgagagtggggttctgaggctcccctatggggacagttccgttcttgaagtgtcagtgttggggaatatctgtggcctatgaggcccatctcaggtttggggatcccccagtccctatgatcagtgttggagtacccccctgggagagcctagtttctttgaggccccaggccctcttttaactacctttgaataggtgttatccctgtatttatggaaataaagttccatttcctcagtagtgcacaatggatctca

SEQ ID NO: 350066 - DNA, 1301 bp, Homo sapiens
gaggctggtcccggccggaattagggatggcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaaaaaaaaa

SEQ ID NO: 350067 - DNA, 1368 bp, Homo sapiens
  misc_feature (311)..(311): n is a, c, g, or t
ggaagtggggagaatcaaggcggggaaatcggactttcgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgntctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagctttttgggttcctatgtatcaaatgacaccgtcttgaaataggagatgaaactgttaatcgggggattctttggggttaaaactttttg

SEQ ID NO: 350068 - DNA, 387 bp, Homo sapiens
caaatgagaccgtcctggagatggaggagcaactggtgagccccctgggattacttccccttctagccgctgtcccaccttattccagagccctctctgtgactcctgagctgaagggttcaccctgtggggaggaggtccaggatcccagcagtaactcactttgtctctccttgtgtctctcttccatgcttccacgccccttcgaccaccttgaaggtttatctgcgggattcttttgggttgaagactctattggcccggggggccatagtgaggtgtccaatggccggtatctcccacacagcctggcactccaaccgtaccctttatgagacctgcattgaaccttggctctcctgaggatatattcaggggtccccagga

SEQ ID NO: 350069 - DNA, 2464 bp, Homo sapiens
taggcttctccaagctgccaaatttaagtattgagtacataaaaggaggagattggcattagtgagaacatggccctgaggcttgatggacccaaagcctcccagggtatgtgcgttttgagggggtggggggtgcacatgggtgtccgggacctcgtctaggtaatgtctgcagccacataggatgatctgactgaatctgtgtgaggacaaccgtttgtgtgcctgtgtgtgcgcgcccacgtgcatgcgcgtgtgtggtcctagtgtaggtgatgtctgcggccacacaggatgctgactgcgtgtgtgactcgtgggcgtgcagatgcaagcacaggcctacgacacatctgtgtacaggctgaagatcacaacgggtctggccagggcccgccgagggcctccgagctggcgagcacaccgacggctggatggggcgacgcttcctgctccggtccctaactcattattaagctcctcgctctttgcagacgctccctgcgcctcccccgctccgggctgcagcggcgcaggcgccgggccgagccgagcgccgagcagggagcgggcggccgcgctccgggccggggtcccgggggagcagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgacagcattccgtgtggtcattggaaactggggaggggagggggagagaaggggaagggaagaaggtggggaggcagtgggtccctcgggacgactccccattcccttcccttggattcttctccttactcaattttccctagacctaaaaacagtttggcagaagacatgtttaataacattttcatatttaaaaaatacagcaacaattctctatct

SEQ ID NO: 350070 - DNA, 1364 bp, Homo sapiens
  misc_feature (1213)..(1213): n is a, c, g, or t
gggcccccaggaggcagcccttcaggggctgcctgggccaggatgagctgtgtgaccttggcgaggtcatttttctccttgagccacagtggccccatccgtcaagtggggatgaaaggacctgctcaggctgtcttgcagaggagcatgtggatgtgaacatctttgaaagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagaaaaaagaaaggggaaaggttctctatcttcatcctcccaaagacgttggggcccattccgaggctggacaacacagattcttttagtgcccgcgggccttgtcagtagtagaccaacccacccttcgttcaggattgtgggcactcgggacacccccaagggaggaaacccccccctaataggggggtcgtgacacacacctagccaacacaaccccgctcggtagcgagcagcaacaaacacaccgacgggcggaggacgccagagagaccgactacaccaacacctacctttcatatcctacctactccctcccacacgcccacacccatcccaatactatacaaccgtggggtgttgctccgcctgcgcgacaccctgcctccaccccacaccattctagtaagcgagcaccaacaacaaccaccacaaaccaccacgacaacctactcgatccacatccgctctccctgcaccattgcgcgagacacagtagatgttcacatcgcccacacgacaccacaactaacgacntaccgccatatcgcaactatccactacagacggacgaaatctcatactttattcgtagtgtggcgagtgaccgaccctatccacgctcaaacaacagctatactaacacgcaccaccccaatacgagcaaccacacagccgaccaccccaa

SEQ ID NO: 350071 - DNA, 1990 bp, Homo sapiens
  misc_feature (207)..(207): n is a, c, g, or t
ggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggncggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350072 - DNA, 1782 bp, Homo sapiens
  misc_feature (6)..(6): n is a, c, g, or t
  misc_feature (250)..(250): n is a, c, g, or t
  misc_feature (337)..(337): n is a, c, g, or t
  misc_feature (345)..(345): n is a, c, g, or t
aaggtntagttccctcctgtaggtggacagcttcagggttcctgattgaggcaccttcatgtccactgacgggtccccctgcagcagtgcccactcatactggacgatggcgtggtcatctgtgctctcgcggccgtctagaaccacccccgtctgtgggcagatgcagaaccacatcctgcccagccttgctaagtggaggcgcatccttttcctgccggggcgaggcgcgcgcggtggccaggggcgngccgtccggcgcgcggctgaggctgtagctgctgtagccgctgtgcagcgcgaacttgcagacgttgcggccgcgctccgggccggngtcccggnggagcagatcctcagaatggcccttggtgctgcaggcgcggtgggctccgggcccaggcaccgagggggcactggatgactctccaggtgcaggaccctgccatctatgactccaggtcttcagcacccacccaccgtggtacagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350073 - DNA, 1637 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (13)..(15): n is a, c, g, or t
  misc_feature (19)..(20): n is a, c, g, or t
ngcngnggctcannntctnncctctcctttccagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350074 - DNA, 2960 bp, Homo sapiens
  misc_feature (207)..(207): n is a, c, g, or t
ggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggncggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcaggtaacctctctcctgaaccctgggatctggggagcaggcggagttctccagcaggggaagtacctctaccaaggtaactaccacccctcccttctagattcctgagtagcagaagcagtacacagtcatggtcttggagccaagagaccgaccaggattctagttcaggccctactgtggattagctctgtgctgcagccaatccatgttagcccccccaagttaggaagacctggaaaccctacaaagccaaccgctttctggaatgtaatattcttggcacttggagttaggatccccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttattaatgcatttaaaaataaatacagcagataaacctgaggagtaaaaatagcagttgatatttattgggcacttaccatgtgccaggcactgtcccaagcactttatgtgtattagttcactgacttctcacggcagccctgggagataggtattcttttcatccccactctagagatgaagacactgagccctgaggtgttaacttgctccaggttgcatagtaagtggcagaggcaggactgatacataagcaggctgacccagggcccgcactctcaacccctgccccacactgacccaccccctatcttgtcagccataccggtggctccaccaccagaccagcccaccccaatcccatccccatgcgcactgaggaatcagacttcctctcagcttcttgtggcctttctagaacaaaaggatctacaactgcatgatgatctcttcaagaagagtgatctctctctccccaattgtcctgcttcagaatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350075 - DNA, 2863 bp, Homo sapiens
  misc_feature (207)..(207): n is a, c, g, or t
ggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggncggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagattcctgagtagcagaagcagtacacagtcatggtcttggagccaagagaccgaccaggattctagttcaggccctactgtggattagctctgtgctgcagccaatccatgttagcccccccaagttaggaagacctggaaaccctacaaagccaaccgctttctggaatgtaatattcttggcacttggagttaggatccccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttattaatgcatttaaaaataaatacagcagataaacctgaggagtaaaaatagcagttgatatttattgggcacttaccatgtgccaggcactgtcccaagcactttatgtgtattagttcactgacttctcacggcagccctgggagataggtattcttttcatccccactctagagatgaagacactgagccctgaggtgttaacttgctccaggttgcatagtaagtggcagaggcaggactgatacataagcaggctgacccagggcccgcactctcaacccctgccccacactgacccaccccctatcttgtcagccataccggtggctccaccaccagaccagcccaccccaatcccatccccatgcgcactgaggaatcagacttcctctcagcttcttgtggcctttctagaacaaaaggatctacaactgcatgatgatctcttcaagaagagtgatctctctctccccaattgtcctgcttcagaatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350076 - DNA, 1924 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (13)..(15): n is a, c, g, or t
  misc_feature (19)..(20): n is a, c, g, or t
ngcngnggctcannntctnncctctcctttccagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatgtacgtcccggcccaggtctctccaggtgtcctggggtgggcatgggctgcactgagaacagaacaaggtgtctgcactaagggctagggagtcagcccaggctgggtggaggggcaggcctagagacattccaagtgcagaggatttcatctaagcccactgccctgtctgctgccaacttggcctccttctgctcctcccacctcatccctgttctgcccccatggtccctgttgctctcccacagcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350077 - DNA, 2835 bp, Homo sapiens
  misc_feature (207)..(207): n is a, c, g, or t
ggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggncggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcaggtaacctctctcctgaaccctgggatctggggagcaggcggagttctccagcaggggaagtacctctaccaaggtaactaccacccctcccttctagattcctgagtagcagaagcagtacacagtcatggtcttggagccaagagaccgaccaggattctagttcaggccctactgtggattagctctgtgctgcagccaatccatgttagcccccccaagttaggaagacctggaaaccctacaaagccaaccgctttctggaatgtaatattcttggcacttggagttaggatccccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttattaatgcatttaaaaataaatacagcagataaacctgaggagtaaaaatagcagttgatatttattgggcacttaccatgtgccaggcactgtcccaagcactttatgtgtattagttcactgacttctcacggcagccctgggagataggtattcttttcatccccactctagagatgaagacactgagccctgaggtgttaacttgctccaggttgcatagtaagtggcagaggcaggactgatacataagcaggctgacccagggcccgcactctcaacccctgccccacactgacccaccccctatcttgtcagccataccggtggctccaccaccagaccagcccaccccaatcccatccccatgcgcactgaggaatcagacttcctctcagcttcttgtggcctttctagaacaaaaggatctacaactgcatgatgatctcttcaagaagagtgatctctctctccccaattgtcctgcttcagaatttttgattgtccccggctgaagttttctgagattccccagcgcctcacagccctgctattgccccctgacccaattgtcatcaaccatgtcatcaggtgaggtggccccagcttgcttctcagaccagggaatgatctcgttcctgccttccctgcccctccctctcctcccactcccatctcttctccctccctgttggatctgccccagccccggggccctggggcccgtatgggggcatcgtggacacgaagggctggacttccctggcagcgtggacccttcagaccagaagaagacggcgtgctatgacattgacgtggaggtggaggagccattaaaggggcagatgagcagcttcctcctatccacggccaaccagcaggagatcagtgctctggacagtaaggtggggcccaagcccagagctggagtgggacattaacccagagatgatagaggagacttttctgagaccagggtgtggttgcagatgagcagtctgggttaaatta

SEQ ID NO: 350078 - DNA, 1364 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (13)..(15): n is a, c, g, or t
  misc_feature (19)..(20): n is a, c, g, or t
  misc_feature (1213)..(1213): n is a, c, g, or t
ngcngnggctcannntctnncctctcctttccagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagaaaaaagaaaggggaaaggttctctatcttcatcctcccaaagacgttggggcccattccgaggctggacaacacagattcttttagtgcccgcgggccttgtcagtagtagaccaacccacccttcgttcaggattgtgggcactcgggacacccccaagggaggaaacccccccctaataggggggtcgtgacacacacctagccaacacaaccccgctcggtagcgagcagcaacaaacacaccgacgggcggaggacgccagagagaccgactacaccaacacctacctttcatatcctacctactccctcccacacgcccacacccatcccaatactatacaaccgtggggtgttgctccgcctgcgcgacaccctgcctccaccccacaccattctagtaagcgagcaccaacaacaaccaccacaaaccaccacgacaacctactcgatccacatccgctctccctgcaccattgcgcgagacacagtagatgttcacatcgcccacacgacaccacaactaacgacntaccgccatatcgcaactatccactacagacggacgaaatctcatactttattcgtagtgtggcgagtgaccgaccctatccacgctcaaacaacagctatactaacacgcaccaccccaatacgagcaaccacacagccgaccaccccaa

SEQ ID NO: 350079 - DNA, 1676 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (13)..(15): n is a, c, g, or t
  misc_feature (19)..(20): n is a, c, g, or t
ngcngnggctcannntctnncctctcctttccagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350080 - DNA, 1296 bp, Homo sapiens
  misc_feature (207)..(207): n is a, c, g, or t
ggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggncggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctgggggtggcaacaagcgtcacattgccgccttgcgttttaacaccgctggacccgccgctcttcgggcca

SEQ ID NO: 350081 - DNA, 2249 bp, Homo sapiens
taggcttctccaagctgccaaatttaagtattgagtacataaaaggaggagattggcattagtgagaacatggccctgaggcttgatggacccaaagcctcccagggtatgtgcgttttgagggggtggggggtgcacatgggtgtccgggacctcgtctaggtaatgtctgcagccacataggatgatctgactgaatctgtgtgaggacaaccgtttgtgtgcctgtgtgtgcgcgcccacgtgcatgcgcgtgtgtggtcctagtgtaggtgatgtctgcggccacacaggatgctgactgcgtgtgtgactcgtgggcgtgcagatgcaagcacaggcctacgacacatctgtgtacaggctgaagatcacaacgggtctggccagggcccgccgagggcctccgagctggcgagcacaccgacggctggatggggcgacgcttcctgctccggtccctaactcattattaagctcctcgctctttgcagacgctccctgcgcctcccccgctccgggctgcagcggcgcaggcgccgggccgagccgagcgccgagcagggagcgggcggccgcgctccgggccggggtcccgggggagcagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350082 - DNA, 1688 bp, Homo sapiens
gagggaaggcagcagcaccctcatgtcacagatgaggacagagctccagggaggaaacggcattccccgggccacatggcccgacatgagcagatcccaagtcgaccagaagccacaaggctgccccccagatccctggcagccaacatctggatgcagccagcatctgtagagagatgggaagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350083 - DNA, 1951 bp, Homo sapiens
  misc_feature (207)..(207): n is a, c, g, or t
ggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggncggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350084 - DNA, 3138 bp, Homo sapiens
  misc_feature (207)..(207): n is a, c, g, or t
ggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggncggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcaggtaacctctctcctgaaccctgggatctggggagcaggcggagttctccagcaggggaagtacctctaccaaggtaactaccacccctcccttctagattcctgagtagcagaagcagtacacagtcatggtcttggagccaagagaccgaccaggattctagttcaggccctactgtggattagctctgtgctgcagccaatccatgttagcccccccaagttaggaagacctggaaaccctacaaagccaaccgctttctggaatgtaatattcttggcacttggagttaggatccccaggttctagtcctgagtctggactctgggtaagtgactcagcgattctgaaccttgtttccttatctttgaagtggagtgacaatacctgtcctatctactctcctgggcagttaggaaaatcaaattgctgcaaaagtgattgagcaaaattccaccaaaacagagaatattcttattaatgcatttaaaaataaatacagcagataaacctgaggagtaaaaatagcagttgatatttattgggcacttaccatgtgccaggcactgtcccaagcactttatgtgtattagttcactgacttctcacggcagccctgggagataggtattcttttcatccccactctagagatgaagacactgagccctgaggtgttaacttgctccaggttgcatagtaagtggcagaggcaggactgatacataagcaggctgacccagggcccgcactctcaacccctgccccacactgacccaccccctatcttgtcagccataccggtggctccaccaccagaccagcccaccccaatcccatccccatgcgcactgaggaatcagacttcctctcagcttcttgtggcctttctagaacaaaaggatctacaactgcatgatgatctcttcaagaagagtgatctctctctccccaattgtcctgcttcagaatttttgattgtccccggctgaagttttctgagattccccagcgcctcacagccctgctattgccccctgacccaattgtcatcaaccatgtcatcaggtgaggtggccccagcttgcttctcagaccagggaatgatctcgttcctgccttccctgcccctccctctcctcccactcccatctcttctccctccctgttggatctgccccagccccggggccctggggcccgtatgggggcatcgtggacacgaagggctggacttccctggcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350085 - DNA, 1687 bp, Homo sapiens
  misc_feature (207)..(207): n is a, c, g, or t
ggcctcggcggcttcgggctgcagcactgctgcccagcgcccgcggccgggctggtcggcgcgcctcgccgcttatctgcgctgtttggacagcgggcttggaaaggcaggcggccccgtccccgccgagtcaacaggcagaccccgggccgccggactatttctgtcttatcagtgcaggaatgcggcagccgcggcggcggcggncggcggcgggcgggcggcggcggcgtgggccgtgggccgtcagggcagccctgaaggggccccctccccactccgctcgagtagaagtgtgagagagcccagcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaaggtggggcccaagcccagagctggagtgggacattaacccagagatgatagaggagacttttctgagaccagggtgtggttgcagatgagcagtctgggttaaatta

SEQ ID NO: 350086 - DNA, 746 bp, Homo sapiens
tacggaggggcgggggcgaacggccggggcgggcgtaggagccaggggcgcggaccccagacaaggaaaccacaaggggacaagcacccagcagatccgaccgatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgaca

SEQ ID NO: 350087 - DNA, 499 bp, Homo sapiens
gcattcgcccggttctgcactctatttctacagcaaaagcggaagctgcgactctatatctccaacacttttaaccctgcgaagcctgatgctgaggattccgacggcagcattgcctcctgggagctacgggtggaggggaagctcctggatgatgtacgtcccggcccaggtctctccaggtgtcctggggtgggcatgggctgcactgagaacagaacaaggtgtctgcactaagggctagggagtcagcccaggctgggtggaggggcaggcctagagacattccaagtgcagaggatttcatctaagcccactgccctgtctgctgccaacttggcctccttctgctcctcccacctcatccctgttctgcccccatggtccctgttgctctcccacagcccagcaaacagaagcggaagttctcttctttcttcaagagtttggtcatcgagctggacaaagatctttatggccctgacaaccacctcgttga

SEQ ID NO: 350088 - DNA, 581 bp, Homo sapiens
tgatctcagaggatccccgcggtcttgctaacatcagtcaccagaggtgtgaagtatgatgctctctctctcctgaagcttaggaaactagatgatgcaatagaagactgcacaaatgcagtgaagcttgatgacacttacataaaagcctacttgagaagagctcagtggtaagtgcctctgatgggtagggggaagagggagttgccgctggcctcaggggaattgccttgtggatgacgaagcagacccagagatgtggtgaggtcatttggtccttccccctgcctctaggtgggattgttccagccctagactatctttatagacctccagcggaggagattgcacaagctccctcagtctcccagtgcctgtgtctaacgcccctcacggtcagtaagtttcctctgatgggagaagactggccttcctgctcacctgtcagacctcagcatggcgatcacctcctcatgacaatgcctacctgtatttttttttcctttatggcatttataattacaatgaatatctggcttacagccatctctcctactagtctagtttaatatactgatggg

SEQ ID NO: 350089 - DNA, 375 bp, Homo sapiens
gcatggttaaagattcacaaacatcacagcaactggcactgtcacaatggctcctgctggagctacaaaacagtccccagagcctatctaagatgagcaacctcagtgactgacatcagacgctcagggtgtgcgagtgtgctcgtccactaaacgtggcagaggacagatcgatggtgccctctgacgaagggttccacaaataagcatgggatacactccctcctgctcctgagggagtcacacggcatatgaacacattaaacctctgtggttttaaaaaaatgtgtttaatttggtggaaaccagcatttctcaaacttacttgatcacacaacctttttttcctccaagtgcctattaacctctcaggaa

SEQ ID NO: 350090 - DNA, 720 bp, Homo sapiens
gaaatgaccggcatgtgatgagtttcctgggccccatccctgctgtgagcacatcctttcctggtctttgcaagctgccaccagagaaccctcttctccagttccaagatccccagtgtagtgggaagaagagtgttcccccagaattcatgcccactcagaaactcagaatgtgaccttatttggaaatagggacttggcaggtataatttgttaagatctctcaataaaattgttctggatttagggtgggccctaaatcctaagaccatgccttgaaaagagaaaggagaggggagcttaaatgcagagacacagggaaaatgccatgtgaagacagaggcagagattgctgcgatgctggcacaagccaaggagtgccagaagccatcagacatgggaagaagcaggaaaggattctcccctagagctgtcatacaggatgacccgctgacatcttggtgttgtatctttagcctccagaactgtgagagaataagtttttattgttttaaacccaccagtggtactttgttacggcagccgtgggaaacgacaccaaggcattaaggtgtcttcagtgtgttaccatgggccctgcctggagtttggagaagctgctctaggatcacccagataccaggagcaatcccaccatcctggtaactacttggagtttccagaattgccatcttcagcagaacatgccacggtttcaca

SEQ ID NO: 350091 - DNA, 528 bp, Homo sapiens
aaaaaaaaaaaagacacccaataccagaaccctgcagaagggaaaagatggcgctgaatacatgaatacacagaactaggcctgagattttcatgggaataagaaaattctttcttggtttcctcaactcttcttgtgatctcaactatcttacttctgaaaacaagcaaatagatatcacttagaacagtggttctcatattgtgattcttggatgagtagtattactatcacctggcaactaattagaaatccaaattttggggctccattcaagacctactcagtgagtagaactccattccagaaattctgagggttgggctagcaacctatttttgtttgtttgttttttgagactagacggagtctcgctctgtcactcacgctagagtgcagtggcccaatctcagctcactgcaacctcccctcctgggttcaagagattctcctgcctcagcctcccgagtagctgggactacaggcgcatgccaccatacctggctaatctttgtatttttagtagag

SEQ ID NO: 350092 - DNA, 1439 bp, Homo sapiens
gtgggacagtacttggcctataggaggcgctcgagagacactggcaccaagatactggatgtgaggactgtaaagggcacataacccacattggatagggtggtccgggaaggcccgaaggtgagggcaaaggcccttagcttggagacagaccagaaagaggacctgcatggctgcagcagattcagccaagaggagggcacaagatggggtgacgatgagtgccatattcacatatgaccttgctgggctcacaccagggctggtgtgatctctgctttgtagacgagaaaaccgaggcccagagtgaacaagtcactttgcagagttgtacagctagtaagcagcaaagcaaaattcaaatccaggtcggcctgtctccattatactctgcagcctctgaaagccatcacgagctattaatacacgggcatgcgagtgatgtccccaccctcaccttcctgagtcgtgcttgctctctctccacttggtgggggacagttctgggcaggcctaaaccctgaacctgagggtgtggccacccctacccacatcccagatggctcaacctcaggactccagtcatgccccgggtgtctccggttcccagcccttttctcctgccaccttcctaccctgccggagccacagcccagcacacctgcttagatctctgcaggggcaagtcaaggcagataacccacaggcaagtgcctggtggctacgctcctcgaggaaggacatgcaccctctcacacactcccacgggtgcacacgataagccagcttgcgcatcgcatgactctcaccccaaacatgcaggtagggacaaactgaaaggcaaagaaaagtctgcagttctccagctttggggagacagggccagggagagtgcaaccagacagaggagttcttctccctgcccttttcaggaggaagacattccctcctgttccctttataaggcagctgctgaaacaggatctcccgtttgcaggggtgggcgtgggtcaggacttgggtggtttttgttgttcttcaaatgcagaggtgtgtagctgacctcatttgcagagctgatgacccaggctctgggctttctccagcctgttgatgcaaccctggctcaaatgtctgttgtagtgagctctgaggcgagcagtgaggacgggatagaagtgccctcgctgccaccagccaggccgcatggcttgcacgctgaccccatgctctcagacaccgaggagaatgcatggggtcttcctcctacccccaggccacaaggctggagttttgtttgggtttttttgtttgtttgttttagttttgtttttcttcttttttcagacgaagtttcactctctgtgcctaggctggagtgcagtggtgtgagatcacgccactgcattccagcctgggcaagagagtgagactgtctc

SEQ ID NO: 350093 - DNA, 726 bp, Homo sapiens
gtcattttggatagagcgcaccctaatgaatgtaatttaacttgagtaccccagtaaaggtcctacctgcaagtaggagagagatgaggggtcaggagtctaatagttacattggagatagagggatcttagcttgcacactccttatgggaacctaatgaacgacgatctgtcactgtccccatcacccccatatgggaacatctagttgcaggaaaacaagttcagggctcccactgattctacattatggtgagtcgtaatattatttcattacacattacaatataataataataatagagataaagtgcacaataagtgtaatgcacttgagtcatcccaaaaccatcccctcaatgacgttctgtggaaaaattgtcttccctgaaaccggttattggtgccagaaaggttggggaccgctggtctagctatctcatgttggcaaactgcaatcccacgaatcatttcttatcttagcctatgtctgggaataggggcaatctttggaattacttcttctctgaagagggtatggcatccagtcgctattgaacttcagtacactattgagaagtctaattgtcaatggccaatagattgatcctctaaattaacccactaaattatgttaaaaggattttagagatttgtcattctaaccgattgataaaaatgttaaatatataaaaagatacatcatggtgtggcagctagccttaa

SEQ ID NO: 350094 - DNA, 1408 bp, Homo sapiens
tctgacgggctcattgtgattttcagccacttgctatttgccactcagaggcaaagcggctgcaagaggtaggagaaagcaagagactccctcacctggaatagagcatccaccgcgatcccagaaaagacaaatcccgttgcaggcacttcaatccacacagcagtcctgggatgagggtcctgttaccatccccatttcacagatgaggaaactgaggcacaaagcatgaagtaacttgaacgtgcccagagtcacactgctagcaaggagcagagctggagtttaggcccaggtggcctgacctcagagcttgtgcactacccgctgcctggtacagtccacagagagggggccagtgcccggcccagaaccacatgccctggggctggagacaggtcagggcagccgaaaggtggagcgccctctccagcacttcttcctcaccccctgcggctttctcctgtgctccgactgccaccacttgcttgggcagccaagcatgacaaactggccagccaccaagcaggacttttcagaggaggagtaaaaacccttgtatgaacgtacactcttcttgtcacacacaaacgcccttccttccaccttcaaaggtgattctgagactgcccgtttttatctttgcttcagttgtgcttgatttacagcctcctgaggtgttttgttttgttttgtgttttgtctctgtcacccaggctagactgcagtggcgcgatctcagctcactgcaacctctgcctcccgggttcaagtgattctcctgcctcagcctcagcctcccaagtagctgggattacaggcacccgccaccacacctggctaactttttttgtattttcagtagagacagagtttcaccatgttggccaggctggtctcgaactcttgacctcaagtgatctgcccgcctaggcctcccaaagtgctgggactacaggcatgagccacgcgcccggcctccctgatgtttttaactaacattgctagtggtttaagttgggcaccgacaagtattagaacgtaattgcagaggtcacgttgtttgaacaccggaacttcaaggcgtgcttgaaccacctgatcaaaggagaagggactgaggaccaacaggagtggggctaaaggcatccttctgctccagtttcctgtgaacccgctcctctgagcacgcctcatcccctctcccctcccctgtcttgctcgcaaggtgccctctgggcccttcctgtccccctcctgtgtctcgtctccccatctggtatggaacctgtttgcaagtgaagcaatatctccgtgttttgtatatccacccgctcttgtagcctttggtttttgttaatgtagagaagctcagattctttattcactttgtaagctttacgccaaa

SEQ ID NO: 350095 - DNA, 301 bp, Homo sapiens
tttaagttgggcaccgacaagtattagaacgtaattgcagaggtcacgttgtttgaacaccggaacttcaaggcgtgcttgaaccacctgatcaaaggagaagggactgaggaccaacaggagtggggctaaaggcatccttctgctccagtttcctgtgaacccgctcctctgaggaaaggagtagtccccacggaagacacaggatccttctgggggtcctccttggccacgtcacacttccagactgtgtggcgggacactgaccatcaagccgacagacgtgggttttaaagctacg

SEQ ID NO: 350096 - DNA, 1508 bp, Homo sapiens
tggcatgtaacctagtaacgtgtacctcaagtgttagacgaagtgccatgtgagtttgcgttgacaagttactgtgccactgacagtcctgttcggaaaggggctccctcagagcccctgggcccagtaacccgcttctgtctcctgactcctgctggataaattgccaggtttatcaaatacaagaaaacacctgctttggctaggaggtaagtcccaaaaagaacgtcttaagtagagcaaaggcatccaccgaggccatttggtggcccctgggaagtggggaagcagggcctgagcgtccccaggctgctagggcagcagctggctcagggcacactctctcgtgccagcttctgccaccagcccagtgtccacggagccgcggggccagaggagctcagggagacctggctgtctagggcatggtacccagtatcccggtgtgtgcccatcctcagccacttgtgtctttctttccatgtgggagttctcccggtgacacctgccctccgttgagggtggaatctgtcactcatgcctttgagggacccagatggaccatccctcttctgcttgctttctacattcctaaaaacctcaacgttaatccctcaccagtcgggccgagtgtggcctcatggttctgccgcggcccagtcttctcccactggcttcacgctagagggcgccatgcgctctgggtgaaatgagacgctggtgtggggtccccatgtagagaccctcaggtccctatccagagaccctccaggcagtgctgggaagacactggtggcggggaccatgaccaggcgggtggagccatgtgtgtctcacacctgccgcccctcactttccttcccgaggtctggtaggtcctctttgggatttgctgtttatttgtatctcccttttctttgatttaagaacaatgccaagtgaaaaagctgggaatgaatttctgagttgctgagtgttccctgctcctaggtaccacgctctgtgcttctcaggcagggaggagatggattcggtggagttgggccaggacgggggcttcaccctgccccctccagactgccgaagcccccaagaagttttgagcccagctgggcctcgcctccccggctcctgggtccattttctgtactggtttgagatcacaggcatcattcagcgaatgctcttgtgtcctctgcataaagagggccctccctggagcacccccggggagctgggactctccagaaagccccgggtgagggctccgtcttgagagagagagaaatcccttctttgggcgattcagtgagttcaggaggaggaggaagcttttccttggctttgaaatcagtgtttttatggagacaaagaacagacctcagtgggaaaaatgaaaacgtaatggaacacggggaggtgtcggagaagaaaggattttccccttcgctttcagagccggcgggagtgcaggtctgttttgcttcagaagcctcacattctgcttt

SEQ ID NO: 350097 - DNA, 1626 bp, Homo sapiens
gggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagggagtcacgaagcccccatcccaaccttcagcaccttccagatcacagacatgacccgcaggagctgccagaacctgggctacactgcggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctaca

SEQ ID NO: 350098 - DNA, 1595 bp, Homo sapiens
gggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagcaccttccagatcacagacatgacccgcaggagctgccagaacctgggctacactgcggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctaca

SEQ ID NO: 350099 - DNA, 1258 bp, Homo sapiens
ggggagacagaggcgaggctggaagtgtcagagcagggttcggccccctctctccgtcacccacagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctaca

SEQ ID NO: 350100 - DNA, 1307 bp, Homo sapiens
gggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagcaccttccagatcacagacatgacccgcaggagctgccagaacctgggctacactgcggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctaca

SEQ ID NO: 350101 - DNA, 686 bp, Homo sapiens
tcagcagaaaaaaagcacatgattgattagtgatgtctgccacgggtaagagcgggaggatgagcagcattacatttgtccttagtgatcaaattcagctccctcactatgcggagaagaaaacatagcctgagagggacagtgacttggccaaggtcaaggactagaaccaggcttcctgattccctgtttagtgctttgttccttaccacacatccacaaactcaagtccataggaaacatcagagatttcctcaaacaggaagtctggccactttccagagttctactgcatggaggcctgggtgcttcattggtcccctcctgtggatcctggcttaactctgtccccctgacaggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctaca

SEQ ID NO: 350102 - DNA, 976 bp, Homo sapiens
gggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagggagtcacgaagcccccatcccaaccttcagcaccttccagatcacagacatgacccgcaggagctgccagaacctgggctacactgcggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggaggtgagtcatggaggaggaaattggcccagacaggggcagggcaagtcctgggtctgggtcctgccacctgccaggaatagatgaaggctcccacttctaccagtctggagtagatggaggcgcccactccaggctcccactcccagagttttcctagcctttcactgaggcatctctccaggggagatcattggagaggctccagtccagccctctgtgtacctcagcttcccctctctaggccccattatcctcctgtccctaaggcctcgaatgctggtattttccacctctctctccctccaggcttactccatctttatctcccagccctctcttcttccacccttgcagaatctccctcctccatttctcagcctcatttctccctaactctttgttcacctcctcagttcagctttgacttctgaaatctggaagtccaactactttcccatccctgtagctgcagtagcagcccctgcaggctgccctttcaggatgaggccaggggaggatgcgggggtctcctgaatgggacc

SEQ ID NO: 350103 - DNA, 328 bp, Homo sapiens
ctctggaagccaaagtctgttcagatcagatgtcttgagactgcaagtacacctaggaggcagagggtagagggtgtgacctagaactgtccttctctctgcagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtaagtctgagcttggtgaggataacttggagcatcaggtccagagaccttca

SEQ ID NO: 350104 - DNA, 1783 bp, Homo sapiens
gggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagcaccttccagatcacagacatgacccgcaggagctgccagaacctgggctacactgcggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacaaaaaaaaaaaaaaaaaaaaaaaaacaaaaaaaaaaagaaaaaaaaaaccacagaaagaagatataaaagaaatccaagataaatcaagaaaaaaatataaaagagagtgataagatgaaaacaaagaaagaaaacagacaaagaaaaagaataggaagaaatagatagatagaaggagaagaagaagg

SEQ ID NO: 350105 - DNA, 1174 bp, Homo sapiens
gggatcacgcctctcgctggtgaccctggccgaggagcgggagatagtctgatccctaacggcgccctccaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctaca

SEQ ID NO: 350106 - DNA, 1844 bp, Homo sapiens
gggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagcaccttccagatcacagacatgacccgcaggagctgccagaacctgggctacactgcggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgtatttaccgcctgcaagcagtttatacagactcaccaagccacagacttgtcttccacaagcacgttcttaccttagccacgaagtgaccaagccacacgtactaaaggttgaactcaaagatatgtacagggtattaaacacataacaagggggacagttaacttccatacaaggtcaaaatcagccacaagttctacaatccagtgctgatatcagataccagcttcaaggacaatttcttttcgaaggcttattccacgtttcgtgaggctagcatgaggtgtgtgcactatgccaggggcaaatttctattctctaattaacccatcagcaaaggctacgcgatctgctgagtctgtaac

SEQ ID NO: 350107 - DNA, 1897 bp, Homo sapiens
ttttttttttaaataatggtagtttacttgaatttgtaacacagtaacacaaaactattttgatctgaacgcaagtatctaatggaacagaataatatacttccttttagtgtgctgcatttggttactgggtaatttaaaattcttcctcagcacaggtgttcaaaaaccagtcttcagagattgttttcatatcagtgtgccaactttggcacattctgctaagtaagaggcttaagtgtagcatgtttctgctgttttgtgtttgttttgttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatctcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagccttcccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgtatagtgatttccaaactttttctttaaatcagaatcacctgaaagaatgtgacaacgtgtaaaaaaaaa

SEQ ID NO: 350108 - DNA, 3508 bp, Homo sapiens
cgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgctttt

SEQ ID NO: 350109 - DNA, 503 bp, Homo sapiens
  misc_feature (495)..(495): n is a, c, g, or t
  misc_feature (503)..(503): n is a, c, g, or t
ttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaactcccttcccccttcccccaccaaaaaaataaagcagggcacgccggtgctttacctgttaaatcctagctacctaagaggctgacacgagaggtctgtcctgggtaacagagcaagacactgtctaaaaacaaaaacccttttngttcgatn

SEQ ID NO: 350110 - DNA, 1173 bp, Homo sapiens
tagtagagatggggtttcgccatgttagccaggatggtctggatctcctgacctcgtgatccgcccgcctgtgcctcccaaagtgttgggattacaggcgtgagccactgtgcccagcctccagcatgatttttttaggccgttcttttgtttgaaagaattcaactaaggatccactctgcctgcctgaccggtttcttcctttcttctctctcatcgggtcccgagttcccatgactgcagcttccagaagagcagagctttggtatcctactcacagcgccaaaactgcaggggccaaggaaagatacaaaattcttgtgtgcagcctcttttggactccagctcttgttctctcgctgaatcccaccgccaccccttcaagtcatcggctgtgattcacctgtgggtttctgaaggctagaagcttccacaatgagccaggaaacaagttctgattggctgggaacagacctctgctccaagattcagggctggcagtattccttctgttctggtggctcgatcttcattgctttcctctggacttgtaagttattccaacaaaccccagctgctctgcagtgaaatgttccaaataattaatatttctgcaggaattaccttgtaaaagatatgtgcttttaagtatttggttattgtgcaaatgtttttgactaccttttgtggccaattttctccttcagcgggctcatgtataattttagataaaagtacaaggaaattatgattccataatcataagtctactttcagcaatacacgtatcttcagagaatctcagcctccctgcagcatcctcctggtgcacagaaaaactgctgaattctggcaagatactcaaaggattctgacgggtgaccatctcaggccggagatatgcccaaccaactggaaaagcagagacagccatggacagatctgctgacgctaaagtttatagacagctgaggtgcaacccatataatcacccagatgttattaggccatgatcattctgtagtaagctacctcccttctgtgtttcctctcacctgacagcctattgtgggcactttcaaggccccactgtgtccaaatcacaccaccaccaaagctcacagaagcacgctggtagatttctcctctttggtggtttcccatgaccagcca

SEQ ID NO: 350111 - DNA, 941 bp, Homo sapiens
cgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagagagtttcgctcaagtccaggctggagtgcaatggcgcgatctcagctcaccgcaatctccgcgtcccggcttcaagcgattccccagcttcagcctcccgagtagtcgggattacaggaatgcgccccacaccccgccaattttgtatttttagtagagacggggtttctccatgttggtcaggctagtctcggaattcccgacctcaggtgatccacccgcctcggcctcaaagtgctgggattacaggcgctagccaccgcgcccggtctgtttagggctttttatccgggcagctggcgacattttgaaaagcttgcttttgctgtttgccagatacatatatatgtattttgagacagagtcttgctcttttgtccaggctagagtgcagtggcgcgttcttggctcaccacaacctctgtctctggatcaagagattatcctgcctcagcctcccaagtagctgggactacaggtgcgccccaccacgcctggctaatttttgtatttttagtaga

SEQ ID NO: 350112 - DNA, 960 bp, Homo sapiens
ttgtcgcgccttgtgcttgttggcctgtggctcttggtcgttttgcgtttggtttccggggctgtccacctctctgtagctttgtaattttcgtttttgttgttgttctagggcttgggtcggaattgttttctttggtggcttgggtccgcgctcttcgtcttccgtgcatttttttgtagtatgttcttgtgtcatcctaggttgttcttagatttgatggcgtgtattgactggttgagttggtggtttgttcctggctgttgttcgtgttggttgtccagggtatgctgctctgtttagggatgtggcaactgttgttatagtattaaaagtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgagttttttgtttcccacttaagttctcattcagtcatttagatgtgataaaagatatttgcttcttgtatatgagccttttaaatctaatatttgatttttctggtgttactttaaaaacatcactttttaagaactgcatagtctc

SEQ ID NO: 350113 - DNA, 4582 bp, Homo sapiens
tagtagagatggggtttcgccatgttagccaggatggtctggatctcctgacctcgtgatccgcccgcctgtgcctcccaaagtgttgggattacaggcgtgagccactgtgcccagcctccagcatgatttttttaggccgttcttttgtttgaaagaattcaactaaggatccactctgcctgcctgaccggtttcttcctttcttctctctcatcgggtcccgagttcccatgactgcagcttccagaagagcagagctttggtatcctactcacagcgccaaaactgcaggggccaaggaaagatacaaaattcttgtgtgcagcctcttttggactccagctcttgttctctcgctgaatcccaccgccaccccttcaagtcatcggctgtgattcacctgtgggtttctgaaggctagaagcttccacaatgagccaggaaacaagttctgattggctgggaacagacctctgctccaagattcagggctggcagtattccttctgttctggtggctcgatcttcattgctttcctctggacttaaacaccctgttgcccaggctggagtgcagtgatgcaatcatagctcacaatggcctcgaactcctgggctcaagccatcctcccgtgtcagactcccaagtagctgggattacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 350114 - DNA, 4136 bp, Homo sapiens
tttcatcgagacagggtcttgcactgtcgcccaggctggagtgaagtggtgcaatctcggctcactgcaacctctgcctcccaggtttaagtgatcttcccacctcagcctcccaagtagctgggactacaggcgcacaccaccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 350115 - DNA, 2096 bp, Homo sapiens
aatgtcactgcatctagcaccattcgttgataggctttggtgaagatagcaccagatcttgtagtgctgactgtgtcagaatccaagggaatatattcttcaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 350116 - DNA, 4456 bp, Homo sapiens
cgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagccttcccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgtatagtgatttccaaactttttctttaaatcagaatcacctgaaagaatgtgacaacgtgtaaaaaaaaa

SEQ ID NO: 350117 - DNA, 1776 bp, Homo sapiens
ttttttttttaaataatggtagtttacttgaatttgtaacacagtaacacaaaactattttgatctgaacgcaagtatctaatggaacagaataatatacttccttttagtgtgctgcatttggttactgggtaatttaaaattcttcctcagcacaggtgttcaaaaaccagtcttcagagattgttttcatatcagtgtgccaactttggcacattctgctaagtaagaggcttaagtgtagcatgtttctgctgttttgtgtttgttttgttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatctcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 350118 - DNA, 3819 bp, Homo sapiens
  misc_feature (3728)..(3728): n is a, c, g, or t
cgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgacttcaagaaaagctttttccaattttaaacctgtcttacggcaagaaacatctaatacgttcttgcaatctcttaatgcccctgtccctttcacaggctcagagcagggtatgaagttctccttggagctcctctgagaacgtctgggactgaaagagttttgctgggtgacactgactttctaaatattccagaactatttccctgaacgtgaaggtcagatgtctgctgcgggcgagttgcgctgtgtgtggggttggtctttggaagtgatgaagatgaatcgctcttgggcaggcacctacctgctccagagatcttttgntaggttttcaaagcctcacttaaactttgaatttgctttgctggaaggtaactcagcctagggtttcttagcgatagtgggtccaaagatc

SEQ ID NO: 350119 - DNA, 1430 bp, Homo sapiens
ttgtcgcgccttgtgcttgttggcctgtggctcttggtcgttttgcgtttggtttccggggctgtccacctctctgtagctttgtaattttcgtttttgttgttgttctagggcttgggtcggaattgttttctttggtggcttgggtccgcgctcttcgtcttccgtgcatttttttgtagtatgttcttgtgtcatcctaggttgttcttagatttgatggcgtgtattgactggttgagttggtggtttgttcctggctgttgttcgtgttggttgtccagggtatgctgctctgtttagggatgtggcaactgttgttatagtattaaaagtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 350120 - DNA, 802 bp, Homo sapiens
aaagtgctgggattacaggcgtgagccaccgtgcccggccaataattgcatagtctcttaatgagatttaatcttttatacccatatgtgtagctcatgatagctatataacctagaagatgaatttatgtaatatgatttgccaaatgagtattcatttgtgatttttttttttttttaaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 350121 - DNA, 1243 bp, Homo sapiens
tagtagagatggggtttcgccatgttagccaggatggtctggatctcctgacctcgtgatccgcccgcctgtgcctcccaaagtgttgggattacaggcgtgagccactgtgcccagcctccagcatgatttttttaggccgttcttttgtttgaaagaattcaactaaggatccactctgcctgcctgaccggtttcttcctttcttctctctcatcgggtcccgagttcccatgactgcagcttccagaagagcagagctttggtatcctactcacagcgccaaaactgcaggggccaaggaaagatacaaaattcttgtgtgcagcctcttttggactccagctcttgttctctcgctgaatcccaccgccaccccttcaagtcatcggctgtgattcacctgtgggtttctgaaggctagaagcttccacaatgagccaggaaacaagttctgattggctgggaacagacctctgctccaagattcagggctggcagtattccttctgttctggtggctcgatcttcattgctttcctctggacttaaacaccctgttgcccaggctggagtgcagtgatgcaatcatagctcacaatggcctcgaactcctgggctcaagccatcctcccgtgtcagactcccaagtagctgggattacagagacggagtcttgctctgtcacccaggctggagtgcagtggtgcgatcgcagctctctgtaacctctgtctccctggttcaagtgattcttctgcctcagcctcccaagtagctgggattacaggttttctactttcctaccttccagaaactcctcctacccatggaatctgccagcagttggattcttgactatctttaggacttttcctaatctcaccttctccatctgtgaaatggaaataatcaaaggtaaacacaaggagggcagagagttctcctgcatctgctactttcttgccttcagctcaacaatccttctgtgaaagaggcatattttgtggtgctatgtgctgatcttccacacagccaaatggaggcagaggtcacagaggaactagaaggatggaaaactgcaggagagtctcgttgccatcactcagtcaatcaaccagttttggatacctgccatgtgccaagccctgactgcagtaccccccataccaaagttatttgcttgcggaatacagaagcgcgaaagagagaaaaatagtagaattggcggccgccagcttgt

SEQ ID NO: 350122 - DNA, 989 bp, Homo sapiens
tagtagagatggggtttcgccatgttagccaggatggtctggatctcctgacctcgtgatccgcccgcctgtgcctcccaaagtgttgggattacaggcgtgagccactgtgcccagcctccagcatgatttttttaggccgttcttttgtttgaaagaattcaactaaggatccactctgcctgcctgaccggtttcttcctttcttctctctcatcgggtcccgagttcccatgactgcagcttccagaagagcagagctttggtatcctactcacagcgccaaaactgcaggggccaagaaacaccctgttgcccaggctggagtgcagtgatgcaatcatagctcacaatggcctcgaactcctgggctcaagccatcctcccgtgtcagactcccaagtagctgggattacagagacggagtcttgctctgtcacccaggctggagtgcagtggtgcgatcgcagctctctgtaacctctgtctccctggttcaagtgattcttctgcctcagcctcccaagtagctgggattacagaaactcctcctacccatggaatctgccagcagttggattcttgactatctttaggacttttcctaatctcaccttctccatctgtgaaatggaaataatcaaaggctcaacaatccttctgtgaaagaggcatattttgtggtgctatgtgctgatcttccacacagccaaatggaggcagaggtcacagaggaactagaaggatggaaaactgcaggagagtctcgttgccatcactcagtcaatcaaccagttttggatacctgccatgtgccaagccctgactgcagtaaaaaggataccaaaataaattacttactgctctcaaaaagcaaaccgtttgctggcagacttgatcatataccaatgactggaggaaggggaaagtgagctttatggtcaaagacgttcaatggcaatattttatttacttatttatttattttt

SEQ ID NO: 350123 - DNA, 1069 bp, Homo sapiens
tagtagagatggggtttcgccatgttagccaggatggtctggatctcctgacctcgtgatccgcccgcctgtgcctcccaaagtgttgggattacaggcgtgagccactgtgcccagcctccagcatgatttttttaggccgttcttttgtttgaaagaattcaactaaggatccactctgcctgcctgaccggtttcttcctttcttctctctcatcgggtcccgagttcccatgactgcagcttccagaagagcagagctttggtatcctactcacagcgccaaaactgcaggggccaagcctcttttggactccagctcttgttctctcgctgaatcccaccgccaccccttcaagtcatcggctgtgattcacctgtgggtttctgaaggctagaagcttccacaatgagccaggaaacaagttctgattggctgggaacagacctctgctccaagattcagggctggcagtattccttctgttctggtggctcgatcttcattgctttcctctggacttaaacaccctgttgcccaggctggagtgcagtgatgcaatcatagctcacaatggcctcgaactcctgggctcaagccatcctcccgtgtcagactcccaagtagctgggattacagaaactcctcctacccatggaatctgccagcagttggattcttgactatctttaggacttttcctaatctcaccttctccatctgtgaaatggaaataatcaaaggtaaacacaaggagggcagagagttctcctgcatctgctactttcttgccttcagctcaacaatccttctgtgaaagaggcatattttgtggtgctatgtgctgatcttccacacagccaaatggaggcagaggtcacagaggaactagaaggatggaaaactgcaggagagtctcgttgccatcactcagtcaatcaaccagttttggatacctgccatgtgccaagccctgactgcagtaccccccataccaaagttatttgcttgcggaatacagaagcgcgaaagagagaaaaatagtagaattggcggccgccagcttgt

SEQ ID NO: 350124 - DNA, 4335 bp, Homo sapiens
cgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 350125 - DNA, 1141 bp, Homo sapiens
cgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacagacaggcagacttttttctatatgatgaaattaagtgtattttaccccagtaaattgcaaggggtggcagttgtgaaagcttctggcatgggaaagggatgtaacatggtctttagctggtttgttttgtggaatggaatttttatttctgtcctttgagtgacttacagcaatattatacccttaataagggtaaactaaactgtccccccatcttgaagggtccaagagaaagttaatgtcatcaggatacatagcctatagatagcgacattctctagggaaagatggagatgcgcactacctggccttcaaactactcactaatgaacacatctgagttgagtttcacaccaaactcctggaaccataactttcttttcccagatctagtcttgtttatcacagacatcaacagcctggcatgtttagcctcacttgggctaggtgcaccccatc

SEQ ID NO: 350126 - DNA, 4063 bp, Homo sapiens
ttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 350127 - DNA, 4492 bp, Homo sapiens
  misc_feature (4355)..(4355): n is a, c, g, or t
  misc_feature (4358)..(4358): n is a, c, g, or t
  misc_feature (4368)..(4370): n is a, c, g, or t
  misc_feature (4378)..(4379): n is a, c, g, or t
  misc_feature (4388)..(4388): n is a, c, g, or t
  misc_feature (4392)..(4393): n is a, c, g, or t
  misc_feature (4395)..(4395): n is a, c, g, or t
  misc_feature (4406)..(4406): n is a, c, g, or t
  misc_feature (4415)..(4415): n is a, c, g, or t
  misc_feature (4426)..(4426): n is a, c, g, or t
  misc_feature (4436)..(4436): n is a, c, g, or t
cgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatgaaaaaaaaaaaaaaaaaaaanaanaaatatttgnnnaaatttgnnagaaaaatnaaannanaaatgtagatnatgaagatnaaaaaaaaaangtaaaatttnataaaaggaaaataatagacatgactacattggaagctttgagttgacttctgaca

SEQ ID NO: 350128 - DNA, 4273 bp, Homo sapiens
  misc_feature (4136)..(4136): n is a, c, g, or t
  misc_feature (4139)..(4139): n is a, c, g, or t
  misc_feature (4149)..(4151): n is a, c, g, or t
  misc_feature (4159)..(4160): n is a, c, g, or t
  misc_feature (4169)..(4169): n is a, c, g, or t
  misc_feature (4173)..(4174): n is a, c, g, or t
  misc_feature (4176)..(4176): n is a, c, g, or t
  misc_feature (4187)..(4187): n is a, c, g, or t
  misc_feature (4196)..(4196): n is a, c, g, or t
  misc_feature (4207)..(4207): n is a, c, g, or t
  misc_feature (4217)..(4217): n is a, c, g, or t
cgcgcacggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaaaaaaaaaaaaaaaaaaaaanaanaaatatttgnnnaaatttgnnagaaaaatnaaannanaaatgtagatnatgaagatnaaaaaaaaaangtaaaatttnataaaaggaaaataatagacatgactacattggaagctttgagttgacttctgaca

SEQ ID NO: 350129 - DNA, 1258 bp, Homo sapiens
ccagtccagttcgtttacagcccttcttggtagatttcaactcgtattcttctggcaaattgcgagtggtgaaattctcaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttggatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggctggcttattagctgtaatggcccagatgggttgttacgtccctgctgaagtgtgcaggctcacaccaattgatagagtgtttactagacttggtgcctcagacagaataatgtcaggtgaaagtacattttttgttgaattaagtgaaactgccagcatactcatgcatgcaacagcacattctctggtgcttgtggatgaattaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcgggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 350130 - DNA, 1171 bp, Homo sapiens
  misc_feature (1)..(1): n is a, c, g, or t
  misc_feature (26)..(27): n is a, c, g, or t
nctaagcgtgactgactctcttaacnnccaccgctacacgattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350131 - DNA, 446 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagagtgcgtaacaactattgacttattggtgaactgaaattcgtaataatggaggtcaaaagcataaacactttttaattaaattaatgattgc

SEQ ID NO: 350132 - DNA, 445 bp, Homo sapiens
ccagattataatgccttttagaaagatgccaagcaaaagtatttagtgattttgaagtgaccagaacatacctatttttaaatactaaggttaaaacatctatttcaggtcaggacgcagtggctcatgcctgtaatcccaacgttttgggagaacaagaagggaggatggcttgagcccaggagttccaggttagtgagctacgattgcgccactgtactccagcctggatgacagaggaaagccctgtatccaaaaacaaacaaaaaaacgttccaaaggcaaatatacatgttttttagactacttaagctctatcatctcatctgctaatgcggataacgtgacaatcaaatgaattaagaaaatcacttaagcaacaatgaaaaactcaccctaaaaagtgaaaataaaacctgtccccgaagttttagtaatgaaagag

SEQ ID NO: 350133 - DNA, 1804 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350134 - DNA, 1893 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggacttgggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350135 - DNA, 1603 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaaaaacaaaaaccaaacaacaaaaacaggagaccgagcagcgaacactcacgaccaacacacccccagacacgtcactaagccgatacacaaccacacacacaccatggtgagccctcccacgccagcaagaacaggatcaaacaagtgggggggcgccggcccacagaagtagcagcgcgtgtcgctgaagaagaccggccagtaggggggggctcacccaaaaaagccggggacgcggctgacaaccgagggcgcgtgtgacaaagggcgggagtaccgg

SEQ ID NO: 350136 - DNA, 2890 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggacttgggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacgtgagttttggaaaccacttacctggtttgccctggctagagcaccttttaatctgttacactttaataaaatatgcgtgtaaagaggggattcctaagaaccaaatgtttttaagattttcctccccaagaatggcctctagtttagacgtttaccatatcaaaacccaactcctgtgaaggtttttaatctcttcctcttgtatcatgaaactttcttgacgatattactgtacttctctgaaacttgaaataactctgagatgcttagtctataggttggcattcaagatcctttacttaccaatattctgctttctcttcaaagaggaatttagaaacctcttcttccttacagacccctcccatcactttctacgggccactttaaaccagaaatgtgcactagaatcctatgtaaagcttctgcaacagtttctccgaccacattccaggcttaacagcatcagtgtccacagtgattcttagccttagacaaaagcaattcttactgctttgtattatagttatttggaatgatgatatcttctctggattgaaaactctgtaataattaattccttttttatatatctgtattcctcataatgccttatacagctctttgtatgtaaaaagataattattgagtaaatacacatttggcaagtaaaaaactacacactataaaacaatttcaaggcaatagagaaagtttgtggacaaatgaggatatatttaaaagtagtagtggtacaaaagatgggttgtgaggaaacatgactgtaagaaagctgttaagttaaggaatatagtatttgggaatgctgataaaaagcaaagtgtttgtgggagacaataggtcttccctattcccttcttcagtgttgaaaattctagttctgaggtaaactcagatctgtaaacattttaaaatctttagagatcagtgtttggttttctttttcatttctactattaaataactttttcttagaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350137 - DNA, 2801 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacgtgagttttggaaaccacttacctggtttgccctggctagagcaccttttaatctgttacactttaataaaatatgcgtgtaaagaggggattcctaagaaccaaatgtttttaagattttcctccccaagaatggcctctagtttagacgtttaccatatcaaaacccaactcctgtgaaggtttttaatctcttcctcttgtatcatgaaactttcttgacgatattactgtacttctctgaaacttgaaataactctgagatgcttagtctataggttggcattcaagatcctttacttaccaatattctgctttctcttcaaagaggaatttagaaacctcttcttccttacagacccctcccatcactttctacgggccactttaaaccagaaatgtgcactagaatcctatgtaaagcttctgcaacagtttctccgaccacattccaggcttaacagcatcagtgtccacagtgattcttagccttagacaaaagcaattcttactgctttgtattatagttatttggaatgatgatatcttctctggattgaaaactctgtaataattaattccttttttatatatctgtattcctcataatgccttatacagctctttgtatgtaaaaagataattattgagtaaatacacatttggcaagtaaaaaactacacactataaaacaatttcaaggcaatagagaaagtttgtggacaaatgaggatatatttaaaagtagtagtggtacaaaagatgggttgtgaggaaacatgactgtaagaaagctgttaagttaaggaatatagtatttgggaatgctgataaaaagcaaagtgtttgtgggagacaataggtcttccctattcccttcttcagtgttgaaaattctagttctgaggtaaactcagatctgtaaacattttaaaatctttagagatcagtgtttggttttctttttcatttctactattaaataactttttcttagaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350138 - DNA, 1745 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350139 - DNA, 1691 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350140 - DNA, 1240 bp, Homo sapiens
  misc_feature (88)..(88): n is a, c, g, or t
  misc_feature (98)..(98): n is a, c, g, or t
  misc_feature (106)..(106): n is a, c, g, or t
cgcccaaaagcgcccatcccagttaattgttacgccagccagtgcgtctgacccaccaagtttggaccttaaggcccaagtgactttnttaattaccncccgctcnaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350141 - DNA, 1072 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgttttcgtggaaagtagagtagtggtgatatagcgggaacgatgcggatatactttctcattgtctgatgtggtgccaggggctggtcacccgggacggc

SEQ ID NO: 350142 - DNA, 1623 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350143 - DNA, 535 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggacttgggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagagtgcgtaacaactattgacttattggtgaactgaaattcgtaataatggaggtcaaaagcataaacactttttaattaaattaatgattgc

SEQ ID NO: 350144 - DNA, 268 bp, Homo sapiens
gggtacgttggggctttgagcgagcctccccgcaccctcccataggaccccaggacagactgcgtcctcgctgacccgccctagggtaggagacagagaatgggaggcttcaatagactctttccttctcccacgcaccccccaaaaaagtggggggtgaacgttccttgagaggccgccttcctttccccacgcctggggctcagcacgccagtaccctgtacactctgtggttgcggcttaacgggactgtggccaagtcccttct

SEQ ID NO: 350145 - DNA, 454 bp, Homo sapiens
cagctggggataaatcaacaaggcttaaaaaaaaaaaggtactacttgaactttttttttctttgctatcagaggcctgcaggatgaactggtcttaagtgtgagaaagatttagctatgtgatgatgtggaggaaggtgaagtactacaaatcaagagagcataaaaacaagaacagaaatatttcagcatgtgaacagtggactaaacaggaaaaaaagcttggggccacactactttctctcaaaatgtcagacaaagaaattcttctgcagactggtggaagcttgtaaggtatttagcaaaaaagttaccagattataatgccttttagaaagatgccaagcaaaagtatttagtgattttgaagtgaccagaacatacctatttttaaatactaaggttaaaacatctatttcaggtcaggacgcagtggctcatgcctgtaatccca

SEQ ID NO: 350146 - DNA, 1632 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacgattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350147 - DNA, 437 bp, Homo sapiens
cccaagggagggagatttcacaaaatgagcagtggataagattagtaatatgaacagcaagttgtgcagcctccggaaagaatgcgcaagggtatcaatcttctaagagtgaggttccaggcaccgaatggactggtcttacagcccggacaagaaacggagaccgcttggttgggctccaagacggaggtgtgcggtcctgccactgcgaacggggcggggaagagaggaaatgacgagccaaaaggggtggtaacggcgccgggccggagacccgggcggagcgggctgggaggaggggcgcggcggagcagggggagtgggcgaactaacggccccctctccccaccagggagacagcgggggcgggcccatagggctccgaggcgtgggcgggccagccccgttgccagccgcacacgggaccccgcggccgc

SEQ ID NO: 350148 - DNA, 1497 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaaaaaaaaaaacaaacgcagacgaccgcacacgagacgaaacccccccccgcgcgcagagcaggcacaccacaaccacaccacgacgccgatatcaacacacaacccgaccagccaaaacacacccgtggcgggcgcaccccgcgccgccgaacaaaagactgccgccaacaacga

SEQ ID NO: 350149 - DNA, 1909 bp, Homo sapiens
gctttcctgattgcagttttggttgagaaggttgttcttccctgctgagatggctggctgacttcaccagtcaagaggcctgcaggatgaactggtcttaagtgtgagaaagatttagctatgtgatgatgtggaggaaggtgaagtactacaaatcaagagagcataaaaacaagaacagaaatatttcagcatgtgaacagtggactaaacaggaaaaaaagcttggggccacactactttctctcaaaatgtcagacaaagaaattcttctgcagactggtggaagcttgtaaggtcaggacgcagtggctcatgcctgtaatcccaacgttttgggagaacaagaagggaggatggcttgagcccaggagttccagctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350150 - DNA, 1578 bp, Homo sapiens
gattgcccattacggccggggactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350151 - DNA, 2777 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggacttgggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacgtgagttttggaaaccacttacctggtttgccctggctagagcaccttttaatctgttacactttaataaaatatgcgtgtaaagaggggattcctaagaaccaaatgtttttaagattttcctccccaagaatggcctctagtttagacgtttaccatatcaaaacccaactcctgtgaaggtttttaatctcttcctcttgtatcatgaaactttcttgacgatattactgtacttctctgaaacttgaaataactctgagatgcttagtctataggttggcattcaagatcctttacttaccaatattctgctttctcttcaaagaggaatttagaaacctcttcttccttacagacccctcccatcactttctacgggccactttaaaccagaaatgtgcactagaatcctatgtaaagcttctgcaacagtttctccgaccacattccaggcttaacagcatcagtgtccacagtgattcttagccttagacaaaagcaattcttactgctttgtattatagttatttggaatgatgatatcttctctggattgaaaactctgtaataattaattccttttttatatatctgtattcctcataatgccttatacagctctttgtatgtaaaaagataattattgagtaaatacacatttggcaagtaaaaaactacacactataaaacaatttcaaggcaatagagaaagtttgtggacaaatgaggatatatttaaaagtagtagtggtacaaaagatgggttgtgaggaaacatgactgtaagaaagctgttaagttaaggaatatagtatttgggaatgctgataaaaagcaaagtgtttgtgggagacaataggtcttccctattcccttcttcagtgttgaaaattctagttctgaggtaaactcagatctgtaaacattttaaaatctttagagatcagtgtttggttttctttttcatttctactattaaataactttttcttagaaaagaaatctggagaagtggctgttctgaagagagatgggcgatatatatattacttggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350152 - DNA, 1780 bp, Homo sapiens
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggacttgggtacgttggggctttgagcgagcctccccgcaccctcccataggaccccaggacagactgcgtcctcgctgacccgccctaggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaaataaaaatttggggagttagtgaggttctgtgcttatgtctatttgttctggacatgggtaatggagggttcacctgcaacttaatttcaaacagtcagacaaagggtccaagcgggaggagaagcaaagtgagaaataagagataaaaatagacaagtcaaaaggcaggtttttagaatctcctcatggtgaactttttctctcttttgtccactgcatggtttctgtgattgaacctgcctgaatttaatcatgaaaacaagtgaaataatgtatgttaaatgcctggcagagtacttagcacagactagtgacccaataaatcagtgattgtcaaaaatccttatgagtcttctttaaaaaaataaaggccacttcctctcaaaaaattctcatacctgtcatctcagcactttgagaggctgagactggaggatgacttgagcccaggagtttgagacaaacctggttaacatagcgagaccctgtctctacaaaaaaaaa

SEQ ID NO: 350153 - DNA, 1347 bp, Homo sapiens
  misc_feature (1301)..(1301): n is a, c, g, or t
  misc_feature (1310)..(1310): n is a, c, g, or t
gcggcggcgggaaaccacggaatttactgccggaagttcggcggccttcgccaaagagtgtgggctcggctagcaagctagaggggctcgtttccgccccgctaccgggcgggggcggccatcttagatgcgtgcaattaagggctttggcgggattggctccgcgtttgggctggtccgctgctccccacctaccagggtcggatccggagcccttccccgcggggcggggacctccaaacaaccgactcctttccaggtgaagggtgacttggctgaagaaacacttaaattctggaaatagcgactcagtatcatggccagcagccttaatgaagatccagaaggaagcagaatcacttatgtgaaaggagacctttttgcatgcccgaaaacagactctttagcccactgtatcagtgaggattgtcgcatgggcgctgggatagctgtcctctttaagaagaaatttggaggggtgcaagaacttttaaatcaacaaaagaaatctggagaagtggctgttctgaagagagatgggcgatatatatattacttgattacaaagaaaagggcttcgcacaagccaacttatgaaaacttacagaagagtttagaggcaatgaagtctcattgtctgaagaatggagtcactgacctctccatgcccaggattggatgtggtcttgatcgtctgcaatgggaaaatgtatctgcgatgatcgaggaggtatttgaggcaacagacatcaaaattactgtgtacacactctgaaccagtgaacattttggatgtttccgtgttctcctgtgtcatctctactgggccataggaccgggcaaacctaccttaaaataggcagaggaaagtttcatgagaagtagtgtgtttaacaagacagactttggttgctgtattcaagtatttggattatgactgtggaggagggcttgcttaagatatgtggttgtgtttttttgtggaaaagtaaggagttaggtggcttgataataggcagggaaaccagattgtcgggactatgacctttttctccagtatgctacctgatttgtttggctggccactaggtggcagcattggttctacttctctgctttttaagagaaatttcaggaaggatgatcattccagttagtttggcattttttgtcgtttgtgcacataacttggtgttatccttatgtcatcagattcctcctaggggagagtttttgttttaattacaaaattaaattctacattgttaccaagaaatttgtggtgataaaaatggaaaatngggatgcgnccgtcactattacttaatttataattccgtttttcaa

SEQ ID NO: 350154 - DNA, 247 bp, Homo sapiens
agttggtgcctgactctgggctgctccagaaatcctatttccaaaatcttttcagctcttagctggcttcctacagtgagctaggatttcagtccaacatttaggaacttcgcttttggtggccagaatatacagaaccagatgctgcagaggaagaagccattagatggtggagaaaggttcatcgtgaagaataaatgagataagctacctcaagtgcctgtaccaaaatagactcacaatacat

SEQ ID NO: 350155 - DNA, 457 bp, Homo sapiens
ctggtcagaggcatctgacccagtgaagccagaggctcctaagtaactgttggaatgatgtgttaacagtccatagctgccaaataggagacccatataaaaggccaagcttgaggtttggggctccctaagccaaacatgtgacacgagtaatgaggtgtttagcatttgaaagggactggcagccctcttctgggtaagtggaaggagaggcactggatcccattctttaggagctgtgcttctgtaaaacagaagttggaatccaaagccagtgaaatatgaattaaagaagatgagagctgcagaaattttatggagaacaaagataatttaatatttgaagtgagtggtggcttttgggaaaatgatgaaaattcattaaattgatagttcattaaattaacagatttgaatgtgtactggtatttgcccttttatttatttatttttagag

SEQ ID NO: 350156 - DNA, 1327 bp, Homo sapiens
tttaaataaatttaaagaaacacaaatgtattattttcaaactgtaaattttataaccattatataaatgggcactgatatacaaaataatgtcagttgctaaaacaagacaattcacagctggcctacatcatataatggcagaaatctttaaacacaaaatctaatgattagaaccagaagttgaaggcccactgaaggagtccttaatattatgaggcctaggtttcaaaaagctaccaattctagaatggattttactctggaactgtttcttgactatttcttgttgcatctctttcagtgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattat

SEQ ID NO: 350157 - DNA, 349 bp, Homo sapiens
cttcgggacagctgcaactcacaaccagtcttttgttgaccttcagctgatttcccaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350158 - DNA, 799 bp, Homo sapiens
tttaaataaatttaaagaaacacaaatgtattattttcaaactgtaaattttataaccattatataaatgggcactgatatacaaaataatgtcagttgctaaaacaagacaattcacagctggcctacatcatataatggcagaaatctttaaacacaaaatctaatgattagaaccagaagttgaaggcccactgaaggagtccttaatattatgaggcctaggtttcaaaaagctaccaattctagaatggattttactctggaactgtttcttgactatttcttgttgcatctctttcagtgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgatttaa

SEQ ID NO: 350159 - DNA, 2862 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350160 - DNA, 2979 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacagagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350161 - DNA, 3452 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaatgtctgtgagtcttcaatgaaagcctctgtctagaaccccgagtgttgatctgtctcccctctgccttggtcagaggccctgctttctcat

SEQ ID NO: 350162 - DNA, 3488 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtaatccacacaggagaaaaaccctatacctgtcatgagtgcggagacaatttctctcacagctccaatcggattcgccacctgagaacgcatacgggagagagaccctaataatgttctgaatgtggactgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350163 - DNA, 3470 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactctgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccacatttttcaagaatttctctataatccccatgttctaagccttgaaaatcatattcaggttcctttttgtaaagaagattttcccatgcatttgctatggttatttgttttacttcttcccaactttttgcccagttaaaaattgcactttttatattgtagattttaattttggaaactcctttatctcctttctcttgctcatcatcactttcttcaaatattacaagactctcttcaagttgcttccatctatacagccgtttgcagctcaagatcacaccttgattcattggttgaatcaaggttgaagtgttatgggggaagaacatacattttattcgaccatcctcactggttagggattcagaggaaggatgagccgggcaactgtccagaagtaacaatgccctgacgtcctcgtcatgaaatcttagaacattaagttgaaaatgtcggacctcaggaacaaagttttgaaaaaaccattctgaaaacaattctctggtgaaccaaacatctttactgggtttatatatcacaggcaatgtacttgtgtcctctttcacacttttgggcagttttgattttccaataatgattgactttaatttatgagttccgtctgcatttgcacataaaaaggcagacaacctttctttgtttattttcttccctggtaggcagatatctttcctacttgcctgagaattttctggcattgacttccaaaagaggtctgtttcatccccactgtatagctgagctagacacagtttctcctctttgattat

SEQ ID NO: 350164 - DNA, 2436 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350165 - DNA, 2942 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactctgtgaagtggaatctctgaaactcaggtgtggcatcaacaaagtcaagaaggtagtccaaactctctcttacagcagataatttaaattcagcagtctgcttctcagcttctcctcctttttgaacaacttcctttgttattccacctttggtttttaggagacaacccttttcttcatctccatttaaccacaccctatcatcatccaacttagtttccaactccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgatttaa

SEQ ID NO: 350166 - DNA, 486 bp, Homo sapiens
ctataccaccctataccaccctatacaccataccacacgtctcatggaggtagtgcttttcttatacctcagcgctaatgaggactgtcctccgcaccggtggtatagctgataaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350167 - DNA, 3361 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350168 - DNA, 3106 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350169 - DNA, 3182 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350170 - DNA, 3638 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaaaaacaagaacaaacacaaaaaacaaacacaaagataagagagaaacaagaaacatcagaggggggggcgcgaaaagaaacccgcagagggggaccaaaaaatcgcggaacacaaatatattgagaaaagagcggcccccacaaagaggagcgacacaataaagagaaagagaaagagcgcagcatattaaacaacgcgaggcaggaaaaacgagcagcaccggaacattcgtgagaaaaccccactatcggggacacacaatggggacacaaccacg

SEQ ID NO: 350171 - DNA, 2993 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactctgtgaagtggaatctctgaaactcaggtgtggcatcaacaaagtcaagaagatacaacagcctcagtcaggaatgacaggaatacctgcatactttccctaactcaataccggaaaacggacaatatgaagagaggagggatggagcaagatgtgcccacaagacaggtgtgataagtttccataaaaactgatgcttcagaagaagggagcgtgaaagactcaaaggcaatgacagagtaatcttgtgtgtagcagagatgcaatgtggcttctccccttccaaaaagacctgattttacctcactgccagaaaagagaatggtgctcaaattgctttgtacatagtgttcactgggcagcagttcatctacctggataagggctccgagctacagggaccctgacattgggatgtatggagagttggaattcaggaacagttgtaccgaatcttgaagtgaagaagaaagtagtttgttgtacatatgaatgaaatccaacttttattgcattcaatatagtattgtcaagcaccgtgatttaa

SEQ ID NO: 350172 - DNA, 2664 bp, Homo sapiens
gacctaatgggcgctggagttcgcaaaacgtgacccggaaattggtcacgagcaggcgccgtgggcttgtggacgcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaa

SEQ ID NO: 350173 - DNA, 4917 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaacctt

SEQ ID NO: 350174 - DNA, 682 bp, Homo sapiens
tggcctggcggggggcgcgggccgggggcagccgctagtcgcggggtggggggcgcgaggggtcgcggactggctgggggcgtctcggcgcggctggcggcggggccggcctaagcgcgcccgcgcacccatctgcccccgtcctaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctgtgagcagcagccagtggaggggttcaggcacctgggttgagactctttggactcct

SEQ ID NO: 350175 - DNA, 1596 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgagcggaggcctcagcaacctgctcttccgctgctcgctcccggaccacctgcccagcgttggcgaggagccccgggaggtgcttctgcggctgtacggagccatcttgcagggcgtggactccctggtgctagaaagcgtgatgttcgccatacttgcggagcggtcgctggggccccagctgtacggagtcttcccagagggccggctggaacagtacatcccaagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttcccaccctgt

SEQ ID NO: 350176 - DNA, 5252 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcag

SEQ ID NO: 350177 - DNA, 5469 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagtttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcag

SEQ ID NO: 350178 - DNA, 4387 bp, Homo sapiens
ttgcactttagcctgggtgagagcaagactctgtctcaaaacaccaaacaaaaaaagaaaaaagaaatgattgccaaggccgggcacggtggctcacccctgtaatcccagcactttgggaggccgaggcaggcggatcacaaggtcaggagatcaagcacaatggctaacacggtgaaaccccatctctactaaaaatacaaaaaattagccaggcgtggcggcaggcgcctgtagtcccaccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcag

SEQ ID NO: 350179 - DNA, 3867 bp, Homo sapiens
ttgcactttagcctgggtgagagcaagactctgtctcaaaacaccaaacaaaaaaagaaaaaagaaatgattgccaaggccgggcacggtggctcacccctgtaatcccagcactttgggaggccgaggcaggcggatcacaaggtcaggagatcaagcacaatggctaacacggtgaaaccccatctctactaaaaatacaaaaaattagccaggcgtggcggcaggcgcctgtagtcccaccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactatagttgcattttattcgtcattacctggcagaggcaaagaaaggtgagaccctctcccaagaggagcagagtttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcag

SEQ ID NO: 350180 - DNA, 5570 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggtaggagccccgcctcccgctgctgagagggcagggtggtaccagggtccacctgccagattcacccctctgtatatcccaggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaacctt

SEQ ID NO: 350181 - DNA, 5742 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaacctt

SEQ ID NO: 350182 - DNA, 5113 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtgagtgctcctgaagggggtgg

SEQ ID NO: 350183 - DNA, 2734 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttcccaccctgt

SEQ ID NO: 350184 - DNA, 4005 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacaggattgttggtgttgcgtgagagagagtggaagcacccagcacagggcctggtttaggacacacggatcccatccagggggcaggaag

SEQ ID NO: 350185 - DNA, 1864 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggctgtcacagaacaggcttttaaatgcttgccagaggccacatgcagtgcctcatgcctgtaatcccagaactttgggagccgaggtgggtgaggtgggaggatcacttgagcccaggaggcggaggttgcagtgagctgagctcatgccattgcacttcagcctgggtgagagcaagactctgtctcaaaacaccaaacaaaaaaa

SEQ ID NO: 350186 - DNA, 3008 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagatgcatcctagggcgtgtacctgcagcccacactgctgtcgtcatcatgcacagtgacgtcctcatccggatcctctagcac

SEQ ID NO: 350187 - DNA, 1950 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggtgaggctggaaagatggcttcccatagatctgttcccatagggctcttgaaaacaggccagctgcccagggcatttgggg

SEQ ID NO: 350188 - DNA, 891 bp, Homo sapiens
ttgcactttagcctgggtgagagcaagactctgtctcaaaacaccaaacaaaaaaagaaaaaagaaatgattgccaaggccgggcacggtggctcacccctgtaatcccagcactttgggaggccgaggcaggcggatcacaaggtcaggagatcaagcacaatggctaacacggtgaaaccccatctctactaaaaatacaaaaaattagccaggcgtggcggcaggcgcctgtagtcccaccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcagagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaacctt

SEQ ID NO: 350189 - DNA, 468 bp, Homo sapiens
ctgtgaacagtagtcaattgtgacagatactagacatccattgtttacaggcatgatgctggcgcagggaccccacagggcccagagcagagcccctcccctccggggctcactgcgcatggtgaagggagtcctgctgcagcccaaagcttaggacagacccggcgctgccatggagccggcagaggaggggaggggcgcacccaggggtctggcagaggcagcagccttccctgcttctgacactgtatccttaggcggtttgcacaaccctctagtgcgtcgtttcctcttctgtgaaatactttataggattgttggtgttgcgtgagagagagtggaagcacccagcacagggcctggtttaggacacacggatcccatccagggggcaggaaggcccaggcagaggccgagcaaaacagggtctgcaggggtcacctagtgcatgggaggtgggcccttccc

SEQ ID NO: 350190 - DNA, 2706 bp, Homo sapiens
tggcctggcggggggcgcgggccgggggcagccgctagtcgcggggtggggggcgcgaggggtcgcggactggctgggggcgtctcggcgcggctggcggcggggccggcctaagcgcgcccgcgcacccatctgcccccgtcctaggtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaacctt

SEQ ID NO: 350191 - DNA, 372 bp, Homo sapiens
aggcagcccttgccatctggccccacggtgatgataactggctggacagtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggtatgaactagagcccccaggtccccgcacgtgctcagctctgtcccagctccaaggcaagggatctggaggacagcccagagctctagtagcagcttccgtgggca

SEQ ID NO: 350192 - DNA, 5523 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcag

SEQ ID NO: 350193 - DNA, 5488 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaacctt

SEQ ID NO: 350194 - DNA, 3733 bp, Homo sapiens
tgggaagaagaagcttgtttattgtgttacatacacagcacggggctctggcctgccagccatggggacctactcaaactcaggaacaggccggtctcctgaacctcagtttcacttgggggcgaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcaggtcctcgctgggcagatgctgctccctgagggcccaggtggtggaggtggggttggagcaggaagggaattttgatttttttttttcttgatagatactaataaaaataaggctgtgtaattttctctcag

SEQ ID NO: 350195 - DNA, 5182 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaacctt

SEQ ID NO: 350196 - DNA, 5611 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtggtttgacaaatccttcactctcatttccttcaagaatggccagttgggtctcaatgcagagcatgcgtgggcagatgctcccatcattgggcacctctgggagtttgtcctgggcacagacagcttccacctgggctacacggagaccgggcactgcctgggcaaaccgaaccctgcgctcgcacctcctacacggctgcagtgggacattccaaaacagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggacaggggtaagttctgcctgacctatgaggcctcaatgaccagaatgttccgggagggacggactgagactgtgcgttcctgtaccagcgagtccacagcctttgtgcaggccatgatggaggggtcccacacaaaagcagacctgcgagatctcttccagaaggctgctaagaagcaccagaatatgtaccgcctggccatgaccggggcagggatcgacaggcacctcttctgcctttacttggtctccaagtacctaggagtcagctctcctttccttgctgaggtgctctcggaaccctggcgtctctccaccagccagatcccccaatcccagatccgcatgttcgacccagagcagcaccccaatcacctgggcgctggaggtggctttggccctgtagcagatgatggctatggagtttcctacatgattgcaggcgagaacacgatcttcttccacatctccagcaagttctcaagctcagagacgaacgcccagcgctttggaaaccacatccgcaaagccctgctggacattgctgatcttttccaagttcccaaggcctacagctgaaggttggagaaatgccagctgccctttcgtccccacactgtggaggaagggacctgtggcagctcacaggcatgaggggtggccgtgcacaggtgcccaggctccaaggacagctccggcagcagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaacctt

SEQ ID NO: 350197 - DNA, 4632 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgccgaccaacccccaggatggcggaagctcaccaggccgtggccttccagttcacggtgaccccagacggggtcgacttccggctcagtcgggaggccctgaaacacgtctacctgtctgggatcaactcctggaagaaacgcctgatccgcatcaagaatggcatcctcaggggcgtgtaccctggcagccccaccagctggctggtcgtcatcatggcaacagtgggttcctccttctgcaacgtggacatctccttggggctggtcagttgcatccagagatgcctccctcaggggtgtggcccctaccagaccccgcagacccgggcacttctcagcatggccatcttctccacgggcgtctgggtgacgggcatcttcttcttccgccaaaccctgaagctgcttctctgctaccatgggtggatgtttgagatgcatggcaagaccagcaacttgaccaggatctgggctatgtgtatccgccttctatccagccggcaccctatgctctacagcttccagacatctctgcccaagcttcctgtgcccagggtgtcagccacaattcagcggtacctagagtctgtgcgccccttgttggatgatgaggaatattaccgcatggagttgctggccaaagaattccaggacaagactgcccccaggctgcagaaatacctggtgctcaagtcatggtgggcaagtaactatgtgagtgactggtgggaagagtacatctaccttcgaggcaggagccctctcatggtgaacagcaactattatgtcatggaccttgtgctcatcaagaatacagacgtgcaggcagcccgcctgggaaacatcatccacgccatgatcatgtatcgccgtaaactggaccgtgaagaaatcaagcctgtgatggcactgggcatagtgcctatgtgctcctaccagatggagaggatgttcaacaccactcggatcccgggcaaggacacagatgtgctacagcacctctcagacagccggcacgtggctgtctaccacaagggacgcttcttcaagctgtggctctatgagggcgcccgtctgctcaagcctcaggatctggagatgcagttccagaggatcctggacgacccctccccacctcagcctggggaggagaagctggcagccctcactgcaggaggaagggtggagtgggcgcaggcacgccaggccttctttagctctggaaagaataaggctgccttggaggccatcgagcgtgccgctttcttcgtggccctggatgaggaatcctactcctatgaccccgaagatgaggccagcctcagcctctatggcaaggccctgctacatggcaactgctacaacaggtgcatctgaactcttggctcccacagaacgcccagcgctttggaaaccacatccgcaaagccctgctggacattgctgatcttttccaagttcccaaggcctacagctgaagcccttaggtacctgtgttttgtttgggaactcggaggccctccccctcccccagctcagaccacagaggtggcaagagaagggctgaagctggaagactgttcatgagggacttgtgtgacctgctttgaaatgtgtgactctgctgagtgacgtaggctctgagatagctgtccacgcccacgtgtttgcttggaataaatacttgcctcagaacctt

SEQ ID NO: 350198 - DNA, 2377 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgagtaggtccccatggctggcaggccagagccccgtgctgtgtatgtaacacaataaacaagcttcttcttcccaccctgt

SEQ ID NO: 350199 - DNA, 3178 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctgactccaccctcccactccttggatttctcctggagcctccagggcaggaccttggagggaggaacaacgagcagaaggccctggcgactgggctgagcccccaagtgaaactgaggttcaggagaccggcctgttcctgagtttgactctaaagccaccatcctcacgagactctggggccccccaggctcccagacctttgagcaaccttcaccgcacagaaacccagccgcgccctgcaattcccaccgcggaaggtgggtgggttctggttctcgccccacgtttttccccgaccccgatttgggagtaggtgtcaggttcctggtgagggcggggcgggggtggctaggcctgaaggacgtggggacacgggccagagtggctggccccacgcacggacaggagtgaacccgagctgtgagtaggggccggcacagggcggcccgcgggggtctgggccctcagccctgcacaggggcgaggacggcgctggggcccgcgcgctcgggtggggaagggcgggctcccgaaccctgcctctgtccaggccggctccacttccaggggcgcctctctcccctgcccgcgccctcgctgacgccccccaactccaggctgcccttcgccgtccttggggctcctggagctttcaaggcccaaatcccc

SEQ ID NO: 350200 - DNA, 2394 bp, Homo sapiens
cccgggccggggcacggagagagccgagcgccgcagccgtgagccgaatagagccggagagacccgagtatgaccggagaagcccaggccggccggaagaggagccgagcgcggccggaaggaaccgagcccgtccgaagggagcggagcgcagcctggcctggggcccggtcgagcccgcgccatggcggccgaggcgacagctgtggccggaagcggggctgttggcggctgcctggccaaagacggcttgcagcagtctaagtgcccggacactaccccaaaacggcggcgcgcctcgtcgctgtcgcgtgacgccgagcgccgagcctaccaatggtgccgggagtacttgggcggggcctggcgccgagtgcagcccgaggagctgagggtttaccccgtgaggtgggaggtcaggggtcagcctctccggtgcgcggatcggggtcaggggtcagccgcggggccctcaggatgctccatgttttcgcccccctcttgcgcccgcgcctggggcggggcggggccggcctggccgggagggggccggggccgcggcaggtagggccggccgcgggctgagcgcgcctggtgtgggtctgcagcggaggcctcagcaacctgctcttccgctgctcgctcccggaccacctgcccagcgttggcgaggagccccgggaggtgcttctgcggctgtacggagccatcttgcaggtgagggggttgtgagcgccgcagcaccagtggctttagggcctgtcgcttacgcgatgcgggtagtattgttcccgttgcgcagttgaggacaccgaggttcacggtctgagtaacacctcattacaccgaagcctgggcctgtattcccagagctttgggaggctgaggcgagaggatcacttgagcacaggagttcgagaccagcctggacaacatagtgagacccccatctctaaataaaaatagaccaacgctaaagcctgtgctccagagcctccaggcaattggatcagaagtcgcagctctggtgggaggaaggcgagccctcatgtgtgtccctgtgccactttgccttggcccctttgctgtccatcctttttcagggcgtggactccctggtgctagaaagcgtgatgttcgccatacttgcggagcggtcgctggggccccagctgtacggagtcttcccagagggccggctggaacagtacatcccagtacgggcccagtcctaccctctcctccccaaggcacctccaccccctaaccctaccccagtgcccaatgtctgcctccacatccctcaccccaagtagggaatttcccccaaaaccctgacttcccctcattgccccagcccttcccactcctgccccagccccatcaccaccctgatagcttcctgggtgcagagtcggccattgaaaactcaagagcttcgagagccagtgttgtcagcagccattgccacgaagatggcgcaatttcatggcatggagatgcctttcaccaaggagccccactggctgtttgggaccatggagcggtgagtcaggagcctcctcagggctcctgtactcctgagctgaacctccatgccagcggatgtgtcgggggctctatccagccctccacttgagtggatctgatgtcatgggtgacagagcaagactccatttcaaaagaaaaaaagaaatgattgccggacaagtcacacagtgataggagcaggggtgcagtagtctggcctgaggggtagataggcgaggggtgggaaagaatagcagagccagtgtatcctattctttgggcttcaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaaggtaggagaaggcatctgagtctcctaacccaagatggaagagccagagggctctggagtgagcagaacctcaccccattcccccagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcgtgtatgtaacacaataaacaagcttcttcttcccaccctgt

SEQ ID NO: 350201 - DNA, 696 bp, Homo sapiens
ctccctcagactgtcttttgcgtaccctcctcctgaagatgtcttggccggctgtgccctttctccaccagctaaacgtcatgcctcctagacatgacccagagtcctgcttggagagccctaccctcagctgacccttcccatgtcttggcagtgccaggcggtcatcgagagttcctaccaggtggccaaggcgttggcagacgacgtggagttgtactgcttccagttcctgccctttggcaaaggcctcatcaagaagtgccggaccagccctgatgcctttgtgcagatcgcgctgcagctggctcacttccgggtaggagccccgcctcccgctgctgagagggcagggtggtaccagggtccacctgccagattcacccctctgtatatcccaggacaggggtaagttctgcctgacctatgaggcctcaatgaccagaatgttccgggagggacggactgagactgtgcgttcctgtaccagcgagtccacagcctttgtgcaggccatgatggaggggtcccacacagtaagtgtcctctgcccatgtgggggtcacagtcgtcgggtgaggtgccccctctgcctcctgtctgcctggagggccagggctactcttcacccctttacttctgccccgcagaaagcagacctgcgagatctcttccagaaggctgctaagaagcacc

SEQ ID NO: 350202 - DNA, 522 bp, Homo sapiens
cggacgcgtgggtcgacccacgcgtcgcccacgcgtcgaaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350203 - DNA, 1004 bp, Homo sapiens
ttggtaccggccgcgagtcgtaaggatcagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaattgtaattgtgggggaacttggcttttaagggaggggatagcatgttaattgagatttctgtcctcagatctctcatccagccactttcctaacctggcaaccactgatttccaagcatagccttggtgcaagggcagaaatctgggctagtggtttaacatgtctgaaactttgggttaagtgtcttcccagaagcttatctttccttccaggggtgggataaaaggagttaatcacccatgcttcttttccccatcctttgcccatctttaccacctgagggattcaggaacttgcccaccctcaagagcctcaaagg

SEQ ID NO: 350204 - DNA, 2383 bp, Homo sapiens
ggtctggtacggtccggaagttagggatagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350205 - DNA, 2566 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaatgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350206 - DNA, 2188 bp, Homo sapiens
ggggttgggtctgggagatttgtcctttcccgcagttggtttccaccttccaaggatctcacagattcctcctatattcctcccagcgacgtcagagaaggcccaaggccgagactcgtgagggggctgtgctgacctaggcaggccgagtcaggtgccttaggggaggatccaggaacggatacctcgcccttccgtgctcgcacactctggctgtcatcgctctgaagactctttaattagatttctcccctttccagtgcgttcacttttctacagatgagtctcttggtggagacagttaccctacctggtccatgtctccctaaccatccggaaggctaacttccacttttcaagcagctttggctggtttccctccttgatttctctggctcccactactattgcttgtctcactgcccctgtcttttctcagggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350207 - DNA, 1912 bp, Homo sapiens
cccgggagtaccaggagcaccagcaggaccatcagcaccaggggatcctttctcgccagcagggccagggggaccagggggaccaacttcaccaggacgtccatctgacccatcttaagatgggtcagatggacccgcttcgcgttatcatcctgttcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350208 - DNA, 2605 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350209 - DNA, 1677 bp, Homo sapiens
agcgtgatgctgcggtcgttatagaggatccccagcgctgaccaataccttgatcactgtggctggggacccgcttcgcgttatcatcctggtcgcagggaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350210 - DNA, 1591 bp, Homo sapiens
agaattgtaaccgggaatggggaggggtcagtggtgaacaggcaatagtgtgatctctgacattgatgagatcctcccttcccccagtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350211 - DNA, 1439 bp, Homo sapiens
ctgagctcggaccctatgaagggcgatgagactcaccctataacttcctgacgttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350212 - DNA, 1246 bp, Homo sapiens
tgggtgtctagaggatcccttacgacgaagcgtagaatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350213 - DNA, 1137 bp, Homo sapiens
  misc_feature (50)..(50): n is a, c, g, or t
catcttggtctttttctcaggcctgagggggaaccatttttggtgtgatnaataccctaaactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350214 - DNA, 1231 bp, Homo sapiens
gggctcgggggcttgatctcacagtgtagcgcgtgcctcagaatgtaggttgaagcagcgagatcttgatctgggcgacgtgtgtacctgtgagacctgtatcgtcatgactacaactgcctagcctggtcctgtacgagcatgtgctcgatgaataagccaatgtctgcagcaccgggatccaaatgttgcgacatactctgttatctattctgtgttgggtttagcccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350215 - DNA, 614 bp, Homo sapiens
attgcgagcgtcggtacccatctatagagtgcccacgtgatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350216 - DNA, 1838 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcaggctccgccctagccctgagcatactgtctcctttcttgtcttgccgtgaagcttgcccttaggaccaagctccactgcatgccatagtctcacaccctctgtgacctgtgaccatgaggagataagcctcattttaaaggtaagtatctgaaagcatatcatctgctctattggtaataaaggtgcgattctggccctgctctgccttgctccctcaccctgtcaattgcttcagaagctggacagggaaagagggtgttatttactgggctttcaaaagaacctgccaggccag

SEQ ID NO: 350217 - DNA, 469 bp, Homo sapiens
gcggccgactactactactaaattcgcggccgcgtcgtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350218 - DNA, 1591 bp, Homo sapiens
  misc_feature (1453)..(1453): n is a, c, g, or t
  misc_feature (1459)..(1459): n is a, c, g, or t
  misc_feature (1490)..(1490): n is a, c, g, or t
  misc_feature (1557)..(1557): n is a, c, g, or t
  misc_feature (1584)..(1584): n is a, c, g, or t
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaaccccctggtaatganggcaangcctggctgcccaatctaatggcaagtcaantggttttccaatgggggctcctggggcctttcaatcaacaagctgggaaggggtcccctcccggaangtaatttcaagcggcaagctccttggntggccga

SEQ ID NO: 350219 - DNA, 1700 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagggtaagatccaccttctatctagcctttaccccccatccatccttgtccctgatctgatttattggccttccctgagagacttctttggctcaacatctcaggagcctgggagaagatcagggatgtatctcctccccatctccctccctgcagcctttctgacagcagccattatcctgctccataccttttggggagttgtgttctttgatgcctgtgagaggagacggtactgggctttgggcctggtggttgggagtcacctactgacatcgggactggtgagttggagacaggggcctgagttagggagaaaagcatttaatggtgagtgggatgtgggggaaagggtatcctcacttcttaacatttttaacttacctgggaggaggaggaaagg

SEQ ID NO: 350220 - DNA, 1455 bp, Homo sapiens
  misc_feature (1317)..(1317): n is a, c, g, or t
  misc_feature (1323)..(1323): n is a, c, g, or t
  misc_feature (1354)..(1354): n is a, c, g, or t
  misc_feature (1421)..(1421): n is a, c, g, or t
  misc_feature (1448)..(1448): n is a, c, g, or t
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaaccccctggtaatganggcaangcctggctgcccaatctaatggcaagtcaantggttttccaatgggggctcctggggcctttcaatcaacaagctgggaaggggtcccctcccggaangtaatttcaagcggcaagctccttggntggccga

SEQ ID NO: 350221 - DNA, 313 bp, Homo sapiens
tctagagtatcaccggagagcgtgtctataatgcatggtataacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350222 - DNA, 2680 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350223 - DNA, 2338 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcaggcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350224 - DNA, 3000 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaattgtaattgtgggggaacttggcttttaagggaggggatagcatgttaattgagatttctgtcctcagatctctcatccagccactttcctaacctggcaaccactgatttccaagcatagccttggtgcaagggcagaaatctgggctagtggtttaacatgtctgaaactttgggttaagtgtcttcccagaagcttatctttccttccaggggtgggataaaaggagttaatcacccatgcttcttttccccatcctttgcccatctttaccacctgagggattcaggaacttgcccaccctcaagagcctcaaagg

SEQ ID NO: 350225 - DNA, 2509 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350226 - DNA, 1608 bp, Homo sapiens
aacatagcagtaaggccctggtgatcggacgaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350227 - DNA, 2552 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350228 - DNA, 2237 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactgactacctggactgatcgcctgacagatcccacctgcctgtccactgcccatgactgagcccagccccagcccgggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaa

SEQ ID NO: 350229 - DNA, 1359 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagtatagctttctgacagagcaatatcatgtcaaacttggggagtggacatgatctgtaaga

SEQ ID NO: 350230 - DNA, 1667 bp, Homo sapiens
atgcggctgctggagaggacccggtgatgagaaaaggaggaggatggaaaaagagtggaaaagaagggaggggaggaaaagggcggagcccgtggccttaaataggatggtgatgcgccagagatgcgcggtttgagtgttcagagattggttgtgctactgaaggcggcggacgtgggacccccggttccgtctcgggaagtaactcatctgccccctctttgaacacctccgctcacgagcgcagcacgtggaaaccgtcagtgatttgtgtctgcaacgtgtgtgagagaatggagattcaaacaggatctaccccctctgcagcccttcaagaagaggtatgattgctaccacttttccccacaaagtgacgaaaggaaacagcgacggaagcgcaaccgaaccctggaattggtgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcagggaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcaggctccgccctagccctgagcatactgtctcctttcttgtcttgccgtgaagcttgcccttaggaccaagctccactgcatgccatagtctcacaccctctgtgacctgtgaccatgaggagataagcctcattttaaaggtaagtatctgaaagcatatcatctgctctattggtaataaaggtgcgattctggccctgctctgccttgctccctcaccctgtcaattgcttcagaagctggacagggaaagagggtgttatttactgggctttcaaaagaacctgccaggccag

SEQ ID NO: 350231 - DNA, 2584 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcct

SEQ ID NO: 350232 - DNA, 543 bp, Homo sapiens
gaatggaataaattctgagactcccatagccctgaattaaaagagaaccccatgaggtgagggcgctagaaggagaccctaactccaagctgtttgtgagccagcctctgtcagggaagatgcttctgatgtcaaactaaacaggaaaaactactgactctatttaccttgggttcaaagaagctgaagttaaactgttgcactgtttacttggggaattctgcagacctgatggggtgaatcttacacattagaggggaataaggcttccctacatgctgtgcttttcaaataacgtttacaaaacaatagtaacgaagcttctgccttttctttttctgatacgccttaagcaatttaagaaagatatagatgaacatcagtctctgacggagagtgtcttacagaagggggagattcttcttcagtgcctgttggagaacaccccaggtgagatgcttaaggttttggatttagccagagcttaatccctgtcagcagcaggcccagggaccgcactatccctggtaaggagctggtacc

SEQ ID NO: 350233 - DNA, 729 bp, Homo sapiens
  misc_feature (282)..(282): n is a, c, g, or t
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagctgggggagccttggacattcccatggggncccaatagaggtgggggatgcatgccccctactgccttggaaaggcttgagcgggaggtgctcaatcgttccgcctttgtacttgcgagggggtgccatgacacggggggattaccctttgctcaccattaactatggcctggggacctttgggagaccgttgatcccgccttgggcaatggcccaccctttcgttaaagagaagggcccacaaacgccaaggtcccttaacaagtgttggcccccagtgctttggaatattgccgcggaaagcgtgagtggaaagtgcaattggccccgcgtggtgtaaagggccgtttcgcacgggaaagggggggtgctgtttggcaagcggccccgtgtgggccaaaccgtttcccatagtgggtttgcggggcccccttttatggcacccgaattcccccgttttggtcgacaaaatagacg

SEQ ID NO: 350234 - DNA, 6486 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350235 - DNA, 6432 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttacagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350236 - DNA, 6269 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccacttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350237 - DNA, 7415 bp, Homo sapiens
  misc_feature (2490)..(2490): n is a, c, g, or t
  misc_feature (2591)..(2591): n is a, c, g, or t
  misc_feature (2596)..(2596): n is a, c, g, or t
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggtaagtggaggaactcaaaaagaaaatttgcccaccaaccctgntgtaacagttggccactacttagaagcttgttgagccaagaactattatttaaacaaatgagatactggaagaagacagccaatggtactaaaaaaggagntgctngtcttcctatgatgatgaaggctcactgcggtgctttccattactgttcacccctgctgcctgctgaggatgagggtgcctctgtgctgccatttctatggcactttcttcaccaccaaccctgccatcccaagacaagagcagcacaacttatctgtacacctactttatttctgcacaggtacacttttccagtatggggccatgacctggccacccctgttctgcaggatcttctccccagctcatttggtactccatctccaagcatctctgacagcaccaagtgcttagagaaacccagagttactgataactttgcaccaccacccctgccctgcacaaagggtctccacatatctcccacaccactcccttccaaaaaggctagggggatggaggggttaaagacaccttggagacttaactggtagtacaactttcttttgctcccttgagaaagtcaaacagaatgacagaaaaggagctaggagagcaaaggtgggtgtgtccaccacagagttgctactgccaatgcttttcataattctgcaattggactgtcgtacgtcgctcctacaacaaaatgtttgtagtgcttaactcatagattttctaggtgagcactataggtatgctaagagcagggagtccctgtgtttttatcagagcaactgtgagacgtcatcttggttctaaaatgaatgcaggggactgctgttgtcgtttcttcctctacaacattatgcctgtaacaaatgctgccttttctctttcaggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350238 - DNA, 5141 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacaacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350239 - DNA, 4770 bp, Homo sapiens
ggcgtgagccactgcgcctggccaggtcattttctttttcagtctgttcactgaggcccacaaaacaaagggtctcaagcactcccaaatctattacagaccacccatgtgaaataacattcttcccagccaatagaaactgatagacctggtagcaggggtaagcatctgaaccttggcatgtcattttatttaagccttatgcccaagaggatctggatgtgcccttacagagatacctgtcttacctctaaagtcaggtaataccagccatcagaaaaccataatatctctgtgcccttctgtgaattacgtaatttcaaagtggagtcagtgagttcttttcttagctttaatcagaagttaacaacataggttctccagtgcaacagaagtccctggagaatcactgttaaaaaagggcagacattcagaaactactgccaggtcctactttgtgtaaaatactatacccttgtatgttcttttgaaaatgcttactggacaacacttgcatgggttttatttctggtttaatttctttgaacctcattgtttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350240 - DNA, 5635 bp, Homo sapiens
  misc_feature (710)..(710): n is a, c, g, or t
  misc_feature (811)..(811): n is a, c, g, or t
  misc_feature (816)..(816): n is a, c, g, or t
ggcgtgagccactgcgcctggccaggtcattttctttttcagtctgttcactgaggcccacaaaacaaagggtctcaagcactcccaaatctattacagaccacccatgtgaaataacattcttcccagccaatagaaactgatagacctggtagcaggggtaagcatctgaaccttggcatgtcattttatttaagccttatgcccaagaggatctggatgtgcccttacagagatacctgtcttacctctaaagtcaggtaataccagccatcagaaaaccataatatctctgtgcccttctgtgaattacgtaatttcaaagtggagtcagtgagttcttttcttagctttaatcagaagttaacaacataggttctccagtgcaacagaagtccctggagaatcactgttaaaaaagggcagacattcagaaactactgccaggtcctactttgtgtaaaatactatacccttgtatgttcttttgaattttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggtaagtggaggaactcaaaaagaaaatttgcccaccaaccctgntgtaacagttggccactacttagaagcttgttgagccaagaactattatttaaacaaatgagatactggaagaagacagccaatggtactaaaaaaggagntgctngtcttcctatgatgatgaaggctcactgcggtgctttccattactgttcacccctgctgcctgctgaggatgagggtgcctctgtgctgccatttctatggcactttcttcaccaccaaccctgccatcccaagacaagagcagcacaacttatctgtacacctactttatttctgcacaggtacacttttccagtatggggccatgacctggccacccctgttctgcaggatcttctccccagctcatttggtactccatctccaagcatctctgacagcaccaagtgcttagagaaacccagagttactgataactttgcaccaccacccctgccctgcacaaagggtctccacatatctcccacaccactcccttccaaaaaggctagggggatggaggggttaaagacaccttggagacttaactggtagtacaactttcttttgctcccttgagaaagtcaaacagaatgacagaaaaggagctaggagagcaaaggtgggtgtgtccaccacagagttgctactgccaatgcttttcataattctgcaattggactgtcgtacgtcgctcctacaacaaaatgtttgtagtgcttaactcatagattttctaggtgagcactataggtatgctaagagcagggagtccctgtgtttttatcagagcaactgtgagacgtcatcttggttctaaaatgaatgcaggggactgctgttgtcgtttcttcctctacaacattatgcctgtaacaaatgctgccttttctctttcaggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350241 - DNA, 2268 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaataaccaaaatctgg

SEQ ID NO: 350242 - DNA, 3575 bp, Homo sapiens
  misc_feature (2490)..(2490): n is a, c, g, or t
  misc_feature (2591)..(2591): n is a, c, g, or t
  misc_feature (2596)..(2596): n is a, c, g, or t
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggtaagtggaggaactcaaaaagaaaatttgcccaccaaccctgntgtaacagttggccactacttagaagcttgttgagccaagaactattatttaaacaaatgagatactggaagaagacagccaatggtactaaaaaaggagntgctngtcttcctatgatgatgaaggctcactgcggtgctttccattactgttcacccctgctgcctgctgaggatgagggtgcctctgtgctgccatttctatggcactttcttcaccaccaaccctgccatcccaagacaagagcagcacaacttatctgtacacctactttatttctgcacaggtacacttttccagtatggggccatgacctggccacccctgttctgcaggatcttctccccagctcatttggtactccatctccaagcatctctgacagcaccaagtgcttagagaaacccagagttactgataactttgcaccaccacccctgccctgcacaaagggtctccacatatctcccacaccactcccttccaaaaaggctagggggatggaggggttaaagacaccttggagacttaactggtagtacaactttcttttgctcccttgagaaagtcaaacagaatgacagaaaaggagctaggagagcaaaggtgggtgtgtccaccacagagttgctactgccaatgcttttcataattctgcaattggactgtcgtacgtcgctcctacaacaaaatgtttgtagtgcttaactcatagattttctaggtgagcactataggtatgctaagagcagggagtccctgtgtttttatcagagcaactgtgagacgtcatcttggttctaaaatgaatgcaggggactgctgttgtcgtttcttcctctacaacattatgcctgtaacaaatgctgccttttctctttcaggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaacta

SEQ ID NO: 350243 - DNA, 2168 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggttggaccggtggccattctcagacccagatgttgaagggcagcttcccaggaaaggaggagaacagggaaaagaatcactggtgcaatgtgtgaagagaaacatggacgtatctggctccaagatgctgattctagttagtaatggtgctgatccaagaattggtttccatggcaggcacgcctcttctgggctgctccattcctacctgcaaggctgggttttctcagcctgtcatttttgatgtcacaccaggctgtggttttcattgctttggcagagggaggtacagagtcgtggagtcgggacagacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaataaccaaaatctgg

SEQ ID NO: 350244 - DNA, 2235 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaacta

SEQ ID NO: 350245 - DNA, 460 bp, Homo sapiens
agagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaataaccaaaatctgg

SEQ ID NO: 350246 - DNA, 6067 bp, Homo sapiens
gttctgctctccggggaaagccaggtggagaagaaggtctccagaccccatggtggcaggaggcaggccactgagtgcaggctcagacctctcaggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350247 - DNA, 6458 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350248 - DNA, 5699 bp, Homo sapiens
  misc_feature (774)..(774): n is a, c, g, or t
  misc_feature (875)..(875): n is a, c, g, or t
  misc_feature (880)..(880): n is a, c, g, or t
ggcgtgagccactgcgcctggccaggtcattttctttttcagtctgttcactgaggcccacaaaacaaagggtctcaagcactcccaaatctattacagaccacccatgtgaaataacattcttcccagccaatagaaactgatagacctggtagcaggggtaagcatctgaaccttggcatgtcattttatttaagccttatgcccaagaggatctggatgtgcccttacagagatacctgtcttacctctaaagtcaggtaataccagccatcagaaaaccataatatctctgtgcccttctgtgaattacgtaatttcaaagtggagtcagtgagttcttttcttagctttaatcagaagttaacaacataggttctccagtgcaacagaagtccctggagaatcactgttaaaaaagggcagacattcagaaactactgccaggtcctactttgtgtaaaatactatacccttgtatgttcttttgaaaatgcttactggacaacacttgcatgggttttatttctggtttaatttctttgaacctcattgtttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggtaagtggaggaactcaaaaagaaaatttgcccaccaaccctgntgtaacagttggccactacttagaagcttgttgagccaagaactattatttaaacaaatgagatactggaagaagacagccaatggtactaaaaaaggagntgctngtcttcctatgatgatgaaggctcactgcggtgctttccattactgttcacccctgctgcctgctgaggatgagggtgcctctgtgctgccatttctatggcactttcttcaccaccaaccctgccatcccaagacaagagcagcacaacttatctgtacacctactttatttctgcacaggtacacttttccagtatggggccatgacctggccacccctgttctgcaggatcttctccccagctcatttggtactccatctccaagcatctctgacagcaccaagtgcttagagaaacccagagttactgataactttgcaccaccacccctgccctgcacaaagggtctccacatatctcccacaccactcccttccaaaaaggctagggggatggaggggttaaagacaccttggagacttaactggtagtacaactttcttttgctcccttgagaaagtcaaacagaatgacagaaaaggagctaggagagcaaaggtgggtgtgtccaccacagagttgctactgccaatgcttttcataattctgcaattggactgtcgtacgtcgctcctacaacaaaatgtttgtagtgcttaactcatagattttctaggtgagcactataggtatgctaagagcagggagtccctgtgtttttatcagagcaactgtgagacgtcatcttggttctaaaatgaatgcaggggactgctgttgtcgtttcttcctctacaacattatgcctgtaacaaatgctgccttttctctttcaggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350249 - DNA, 4664 bp, Homo sapiens
gaatggaataaattctgagactcccatagccctgaattaaaagagaaccccatgaggtgagggcgctagaaggagaccctaactccaagctgtttgtgagccagcctctgtcagggaagatgcttctgatgtcaaactaaacaggaaaaactactgactctatttaccttgggttcaaagaagctgaagttaaactgttgcactgtttacttggggaattctgcagacctgatggggtgaatcttacacattagaggggaataaggcttccctacatgctgtgcttttcaaataacgtttacaaaacaatagtaacgaagcttctgccttttctttttctgatacgccttaagcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350250 - DNA, 4365 bp, Homo sapiens
gctctcgcccggctggagctgtttcgatgcggagtacgctctaattctgcggacccgtctccgagagcgggcgccctactactcgcgcgcgctgctccggactgcgcggccggcccggatgtggttgcccccgcgtcgcgtctcccgctatttccgctgtcagaagctcgcgctccgtcgtttgttactgccctcgtcatcaaggaaggtgccgcgtgccatgatggctggcctcgcgacatagccccacttgtgaacttgccattccgggcccgatggacgagcgatgcctcccccggtgatccgggggctcaacgctgcgacatattgtccgggctggagctacaattctgtcggccaaacactggctagtgagaaaaaaatccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaatggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacagggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaacctattcatttttggcttgtgtttagcttaaattttatcattaaattaaggagcccacaacaaaatgtgttgccagcagccatatcccaagcccctgcgtgaagaatgttttggctgctatttcaacctaaggaaacaacgtttgacctcagtcaccttaaaatgccagtgtgggcagaagattttttattcctcacaattaaaaaccaaacaaaaccccctaggatcttgaaggtcctatttcagaaaatcttcatatatgcaaaatgtcaccaaaataaatacatttgcctcaattatcattaccacccagtattcatgttttaatttttagggatataatttctaaatttagagcaatcaaatttcctgcttcctatcttaatgcttaaaccctcctccaacaccaagttaagcaactgtggaggataaaatagttgaatctgactgaaagcatggaagaaaaacattagcacacattagtctgatcatttgccaattaggaaaggtgctgctttctacctctaccacagatgcatttatgaaatgttgatcaatgaagctatttcaaatggttttagagaaggatcagagataacgggctagatagcatacattctaaacttgttttacatatagtttgagctccctgaaccactgaagttggttaaatcc

SEQ ID NO: 350251 - DNA, 2051 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccacttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaataaccaaaatctgg

SEQ ID NO: 350252 - DNA, 923 bp, Homo sapiens
gccctgcgcgttttgggctgcggttggagggccgcagttgcagtcagggtccgccagctcggggccagcgcatggggctgctgagaccgctccggacgtgcgaagcgttcgcggtgcggtaggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcagcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacaacattttgctgtcagctggaagagctgatctgctggctgtataatgttgcagatgttactgaccacgggactgcagccaggtccaatcttacaagtctcaagtcttctctgcagctttaccgggtaatatgcggtcctggctctggcttgttccctcacaagagtgtggctaaattactcgattacaaagtaaaatctcaaataaccaaaatctgg

SEQ ID NO: 350253 - DNA, 2111 bp, Homo sapiens
  misc_feature (1598)..(1598): n is a, c, g, or t
gggccttgaacgtccacatctgggacatcaatgtccactttggggtccctgatgtcaacttcggggcccttgaggtcgccttccactttgggcagagaaatgtccatgtcgcccttcacctttggacctttcagattcaggtcaacttcaggcatagagatcttcggtgccttgaggtgtaagtcaggcattttaaatttggggcccttcagtttcccttctggaccatgaatgtcaatatcaggagtgtcaatgcccactttagggcctttgacatccactttgggacctttcagatctccctccagtttaggaacggaaatgtccatatctccttttatcttaggtcctttcaaattcaaatcaatgtcactcatggagatttgtgggcttttgaaatgtacatcaggcatcttaaacttgggacctttgagcttcccttcaggaccttcaatgtctacctctggccctttcagatcactttccaccttaggtagtgaaacatccacatcacccttcaccttgggacctttcaggtgcaaatcaaagtcaggcatagagattttgggagctttgatgttcatctcaggcatcttaaatttgggccccttcaattttccttccggaccttcaatattgacatcaggtgtgtcaatgtccaaactggggccttttatgtcaatttcagggcccttgagatcaccttccactttgggcagagagacatccacatcacctttcactttgggacccttcaagttaaagtcaatgtcaggcatggagattttgggggccttgatgttcatctctggcatcttgaactttggacccttgagttttgcatctggaccttcgatactgacatcaggggcatcaatgtccactttggggccagaaatctcaatgtcagccttaggaagggtaacatccacatctgggccctctcctttgaatcctggcatgctgaatttgggcattttcaccttgggcatcttcaggtgccagtctgggccatgaacatccacatctggggcatcgatgtccactttggggcccttgatgtcaacttctgggcccttgcaggtcaccttccactttaggaagggaaacatccacatcacccttcaccttgggacctttcagatgcaaatcaaagtcaggcatggagatcttgggggctttgatgttcatctcaggcatcttgaatttagggccctttagtttcgcatctggaccttcgatattcacatcaggaacatcaatgtccaccttgggtcctgagacgtcaaggtcagccttgggcaggttcacatccacatctgggccctctcctttgaagccaggcatgctgaacttgggcattttcactttgggcatttttaagtgccagtctgggccttgaacgtccacatctgggacatcaatgtccactttggggcccttgatgtcaacttcagggcactttcatttcaccttctaccttgggcacagacacatccacatcccctttgactttggggcctttcaagtgtaagtccacatcaggcatggagatcttgggggtcttgaaatgcatctcaggcatcttaaacttgggncccttcagcttcccttctggaccttcgaggctcacatctggggcttcgatgtccaccttgggtcctgagacaacaacgtcagccttaggcaagttcacatccacttctgggccctcgcctttgaggctgggcatgctgaacttgggcattttcatcttgggtattttcaggctccagtccaggccttggccttccacatctggtgctttaatatctaccttgggacctctgatgtccacatctggaacctgcatttcaccctctatctttggtgcagagatatctacatttcctttcattttgggtcctttaagatccaggtcaacatctggcaaagacatcttaggagctctgaagtgcatctcaggcatcttaaacttcgggcctttcaacttcccttcaggtccttcaaggctcagatctggagcattagtatctacttttggtgcagaaatgtccacattcgctttggacaggttcacatcaaattctggcccctctcctttgaggctg

SEQ ID NO: 350254 - DNA, 2182 bp, Homo sapiens
gggccttgaacgtccacatctgggacatcaatgtccactttggggtccctgatgtcaacttcggggcccttgaggtcgccttccactttgggcagagaaatgtccatgtcgcccttcacctttggacctttcagattcaggtcaacttcaggcatagagatcttcggtgccttgaggtgtaagtcaggcattttaaatttggggcccttcagtttcccttctggaccatgaatgtcaatatcaggagtgtcaatgcccactttagggcctttgacatccactttgggacctttcagatctccctccagtttaggaacggaaatgtccatatctccttttatcttaggtcctttcaaattcaaatcaatgtcactcatggagatttgtgggcttttgaaatgtacatcaggcatcttaaacttgggacctttgagcttcccttcaggaccttcaatgtctacctctggccctttcagatcactttccaccttaggtagtgaaacatccacatcacccttcaccttgggacctttcaggtgcaaatcaaagtcaggcatagagattttgggagctttgatgttcatctcaggcatcttaaatttgggccccttcaattttccttccggaccttcaatattgacatcaggtgtgtcaatgtccaaactggggccttttatgtcaatttcagggcccttgagatcaccttccactttgggcagagagacatccacatcacctttcactttgggacccttcaagttaaagtcaatgtcaggcatggagattttgggggccttgatgttcatctctggcatcttgaactttggacccttgagttttgcatctggaccttcgatactgacatcaggggcatcaatgtccactttggggccagaaatctcaatgtcagccttaggaagggtaacatccacatctgggccctctcctttgaatcctggcatgctgaatttgggcattttcaccttgggcatcttcaggtgccagtctgggccatgaacatccacatctggggcatcgatgtccactttggggcccttgatgtcaacttctgggcccttgcaggtcaccttccactttaggaagggaaacatccacatcacccttcaccttgggacctttcagatgcaaatcaaagtcaggcatggagatcttgggggctttgatgttcatctcaggcatcttgaatttagggccctttagtttcgcatctggaccttcgatattcacatcaggaacatcaatgtccaccttgggtcctgagacgtcaaggtcagccttgggcaggttcacatccacatctgggccctctcctttgaagccaggcatgctgaacttgggcattttcactttgggcatttttaagtgccagtctgggccttgaacgtccacatctgggacatcaatgtccactttggggcccttgatgtcaacttcagggcaccttgaggtcgccttccactttgggcagagaaacgtccacgtcgcccttcatctttggacctttcagattcaggtcaacttcaggcatagagatcttcggtgccttgaggtgcaggtcaggcattttaaatttggggcccttcagtttcccttctggaccatgaatatcaatatcaggagtgtcaatgtccactttgggtcctgagacatcaatgtcagctttgggcaaattaacatccacttctgggccctctcctttaaatcctggcatgctgaatttgggcattttcaccttgggcatcttcaggtgccagtctgggccatgaacatccacatctggggcatcaatgtccactttggggcccttgatgtcaacttcaggggcctttagatcaccttccatcttaggcagagaaacatccacatctcctttcaccttagggcctttcagatgcaaatcaaagtcaggcatggagatcttgggggctttgatgttcatctctggcatcttgaatttagggcccttcagtttcgcatctggaccttcaatattcacatctggaacatcaacgtccaccttgggtcctgagacgtcaaggtcagccttgggcaggttcacatccacttctggaccttctcctttgaagccaggcatgctgatcttgggcatttttatcttaggcatcttcaggtgaaggtccagaagtgattgttccccgct

SEQ ID NO: 350255 - DNA, 551 bp, Homo sapiens
gtaccgtctataatgacatgctgcatctgacaggtcactggtccgcctttttacaagctgttcgattactgatataagcccggtgctttaaatcctggcatgctgaatttgggcattttcaccttgggcatcttcaggtgccagtctgggccatgaacatccacatctggggcatcaatgtccactttggggcccttgatgtcaacttcaggggcctttagatcaccttccatcttaggcagagaaacatccacatctcctttcaccttagggcctttcagatgcaaatcaaagtcaggcatggagatcttgggggctttgatgttcatctctggcatcttgaatttagggcccttcagtttcgcatctggaccttcaatattcacatctggaacatcaacgtccaccttgggtcctgagacgtcaaggtcagccttgggcaggttcacatccacttctggaccttctcctttgaagccaggcatgctgatcttgggcatttttatcttaggcatcttcaggtgaaggtccagaagtgattgttccccgct

SEQ ID NO: 350256 - DNA, 408 bp, Homo sapiens
atctacatttcctttcattttgggtcctttaagatccaggtcaacatctggcaaagacatcttaggagctctgaagtgcatctcaggcatcttaaacttcgggcctttcaacttcccttcaggtccttcaaggctcagatctggagcattagtatctacttttggtgcagaaatgtccacattcgctttggacaggttcacatcaaattctggcccctctcctttgaggctgggcatgctaaatttgggcattttaatctttggcatcttcaagttccagtctggaccctgcatttcaacatctggggcactgacatctacttttgggcctttcaggtccccttccagctttggcactgtcatatcatattctacctttactttaggacctttcatatgcaagtccac

SEQ ID NO: 350257 - DNA, 764 bp, Homo sapiens
  misc_feature (251)..(251): n is a, c, g, or t
cagttactttaggagcagatatctccagcgatggcatcttcaaagatgggccactgagtttggcatcagggccttcgaaatccagacgtggacctttaagatctacttctgggcctttcaaagtcccttcaaccttagggacagacacatcaaaatctccttttactttgggtcctttcaaatccaggtcaacatcaggcatggagatcttgggggtcttgaaatgcatctcaggcatcttaaacttgggncccttcagcttcccttctggaccttcgaggctcacatctggggcttcgatgtccaccttgggtcctgagacaacaacgtcagccttaggcaagttcacatccacttctgggccctcgcctttgaggctgggcatgctgaacttgggcattttcatcttgggtattttcaggctccagtccaggccttggccttccacatctggtgctttaatatctaccttgggacctctgatgtccacatctggaacctgcatttcaccctctatctttggtgcagagatatctacatttcctttcattttgggtcctttaagatccaggtcaacatctggcaaagacatcttaggagctctgaagtgcatctcaggcatcttaaacttcgggcctttcaacttcccttcaggtccttcaaggctcagatctggagcattagtatctacttttggtgcagaaatgtccacattcgctttggacaggttcacatcaaattctggcccctctcctttgaggctg

SEQ ID NO: 350258 - DNA, 2071 bp, Homo sapiens
gggccttgaacgtccacatctgggacatcaatgtccactttggggtccctgatgtcaacttcggggcccttgaggtcgccttccactttgggcagagaaatgtccatgtcgcccttcacctttggacctttcagattcaggtcaacttcaggcatagagatcttcggtgccttgaggtgtaagtcaggcattttaaatttggggcccttcagtttcccttctggaccatgaatgtcaatatcaggagtgtcaatgcccactttagggcctttgacatccactttgggacctttcagatctccctccagtttaggaacggaaatgtccatatctccttttatcttaggtcctttcaaattcaaatcaatgtcactcatggagatttgtgggcttttgaaatgtacatcaggcatcttaaacttgggacctttgagcttcccttcaggaccttcaatgtctacctctggccctttcagatcactttccaccttaggtagtgaaacatccacatcacccttcaccttgggacctttcaggtgcaaatcaaagtcaggcatagagattttgggagctttgatgttcatctcaggcatcttaaatttgggccccttcaattttccttccggaccttcaatattgacatcaggtgtgtcaatgtccaaactggggccttttatgtcaatttcagggcccttgagatcaccttccactttgggcagagagacatccacatcacctttcactttgggacccttcaagttaaagtcaatgtcaggcatggagattttgggggccttgatgttcatctctggcatcttgaactttggacccttgagttttgcatctggaccttcgatactgacatcaggggcatcaatgtccactttggggccagaaatctcaatgtcagccttaggaagggtaacatccacatctgggccctctcctttgaatcctggcatgctgaatttgggcattttcaccttgggcatcttcaggtgccagtctgggccatgaacatccacatctggggcatcgatgtccactttggggcccttgatgtcaacttctgggcccttgcaggtcaccttccactttaggaagggaaacatccacatcacccttcaccttgggacctttcagatgcaaatcaaagtcaggcatggagatcttgggggctttgatgttcatctcaggcatcttgaatttagggccctttagtttcgcatctggaccttcgatattcacatcaggaacatcaatgtccaccttgggtcctgagacgtcaaggtcagccttgggcaggttcacatccacatctgggccctctcctttgaagccaggcatgctgaacttgggcattttcactttgggcatttttaagtgccagtctgggccttgaacgtccacatctgggacatcaatgtccactttggggcccttgatgtcaacttcagggcaccttgaggtcgccttccactttgggcagagaaacgtccacgtcgcccttcatctttggacctttcagattcaggtcaacttcaggcatagagatcttcggtgccttgaggtgcaggtcaggcattttaaatttggggcccttcagtttcccttctggaccatgaatatcaatatcaggagtgtcaatgtccactttgggtcctgagacatcaatgtcagctttgggcaaattaacatccacttctgggccctctcctttaaatcctggcatgctgaatttgggcattttcaccttgggcatcttcaggtgccagtctgggccatgaacatccacatctggggcatcaatgtccactttggggcccttgatgtcaacttcaggggcctttagatcaccttccatcttaggcagagaaacatccacatctcctttcaccttagggcctttcagatgcaaatcaaagtcaggcatggagatcttgggggctttgatgttcatctctggcatcttgaatttagggcccttcagtttcgcatctggaccttcaatattcacatcagaaggtccaggtatgcctggtagcgctcgggttaagaaggtccaggtatg

SEQ ID NO: 350259 - DNA, 571 bp, Homo sapiens
ctttaaatcctggcatgctgaatttgggcattttcaccttgggcatcttcaggtgccagtctgggccatgaacatccacatctggggcatcaatgtccactttggggcccttgatgtcaacttcaggggcctttagatcaccttccatcttaggcagagaaacatccacatctcctttcaccttagggcctttcagatgcaaatcaaagtcaggcatggagatcttgggggctttgatgttcatctctggcatcttgaatttagggcccttcagtttcgcatctggaccttcaatattcacatctggaacatcaacgtccaccttgggtcctgagacgtcaaggtcagccttgggcaggttcacatccacttctggaccttctcctttgaagccaggcatgctgatcttgggcatttttatcttaggcatcttcaggtgccagtctgggcctcgaacatccacatctggggcattaatatccactttggggcctttaatatccaagtcaggaactttcatgtcaccttccacttttggcagagacacatccatatcacccttcactttggg

SEQ ID NO: 350260 - DNA, 825 bp, Homo sapiens
gtcagcattgagccaatgagtggttggatgagggagtaagttaccatcagcgtctctgcctgcagtaattatgcacggcggcggctgtcctgttgctgtgccagggtatttgcagaagcttcatgattccagaggaacaatgtcacactttgtagaagtgccacacttagcttggcccagtgaattgagtcgttagcgtagccaggctgtctcctgtaatggagtgggaacactggaagggggctgtcttctgtgatggaatggggacactggaagaggcactttcttttggctgcctcagctgcactttctgcctcacttcttggatcatggcctctcacacctggctgatgactgagtctgtgtcccccatttgccgatgacaccagcacctctgagcaccccagggccgcccctcctgctgttgcatctgtttctgagcatcttaaaatcacctttgaaggaaaagtcctcacaggaacacccccccttgtgccttacagacaaagaagtatgccgatgtgatcatcccacgaggagtggacaatatgggtaagaagctggcctgctgggctgtccccccgcccctcccagagcttgaggcagggacagttccaccagtgtgcagttactgagcactcccctgcgcacgcggcctgccagtgttgatctgcggcacagggttaaaatatgcttaaaaatgtatgtagctgggcgcggtggctcacactggtaatcccagcactttgggaggctgaggcagggggatcactggagcccaggagttcaacagcctggggaacatagcaaaaccccatctctaca

SEQ ID NO: 350261 - DNA, 2082 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350262 - DNA, 2145 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgatcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350263 - DNA, 2149 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350264 - DNA, 1788 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgactcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350265 - DNA, 1299 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgtatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350266 - DNA, 1980 bp, Homo sapiens
gtcagcattgagccaatgagtggttggatgagggagtaagttaccatcagcgtctctgcctgcagtaattatgcacggcggcggctgtcctgttgctgtgccagggtatttgcagaagcttcatgattccagaggaacaatgtcacactttgtagaagtgccacacttagcttggcccagtgaattgagtcgttagcgtagccaggctgtctcctgtaatggagtgggaacactggaagggggctgtcttctgtgatggaatggggacactggaagaggcactttcttttggctgcctcagctgcactttctgcctcacttcttggatcatggcctctcacacctggctgatgactgagtctgtgtcccccatttgccgatgacaccagcacctctgagcaccccagggccgcccctcctgctgttgcatctgtttctgagcatcttaaaatcacctttgaaggaaaagtcctcacaggaacacccccccttgtgccttacagacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350267 - DNA, 854 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccggtacctgtgctcgctgcttcagagcccattttcccctttcacaaggacacatgggacccagtactgtgagagggcttagtgctgggtgacagtgatctgattgaaaaaaaggagaagaatttggctcattatggccacataccctgggagtagt

SEQ ID NO: 350268 - DNA, 2177 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350269 - DNA, 2266 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagaggtaaggcggccgcgggcctccgtgcctgcctggccgaggctggcggcaggtcctgaggtctgaagcacgcctgccccttgccgctgcagttctccgggacgtgcgccgagggagggacctggagcagattctgacgcagtacaccaccttcgtgaagccggccttcgaggagttctgcctgccgacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350270 - DNA, 2141 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350271 - DNA, 2379 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgctgcactttctgcctcacttcttggatcatggcctctcacacctggctgatgactgagtctgtgtcccccatttgccgatgacaccagcacctctgagcaccccagggccgcccctcctgctgttgcatctgtttctgagcatcttaaaatcacctttgaaggaaaagtcctcacaggaacacccccccttgtgccttacagacaaagaagtatgccgatgtgatcatcccacgaggagtggacaatatggttgccatcaacctgatcgtgcagcacatccaggacattctgaatggtgacatctgcaaatggcaccgaggagggtccaatgggcggagctacaagcggaccttttctgagccaggggaccaccctgggatgctgacctctggcaaacggtcacatttggagtccagcagcagaccccactgaggggctgccgagcctcagggcaggtctcccgcccggcatgtgtgttcagggactgagcctggggacgcccacccacacccactgcttcctctcggcgcaccccaggggagtgttagcagcgaggccttcctcactcaggagtggaaactcagatgtgtcactcagactcaacttgctgggacactgacaggcgttcctgaggttttcagccacttaggctcgttgcggtttaaagatccctctaggtcactgagaaatgccacagaatgtgcaggaagcctgggaggcttctgtgaggaatgtgaggcacattattggggaaattgaggagacagcctagacactggctggcctgatgttttgttgacagtgaacccacagtgggagagagttttttccagtctgatctggttcttacacactcacacacataactcaaaagttttgtgaacaagtactttccttttttacatgttacatgtcctcatgttttctgttttctgtttcataacacaaggctggttgtggcctacaaacctaatttcatgacccagtggtttgcagtccagcgtggcctacacggatatggggagccactgagggatgttttccccccttgcttgtgccttaaaggcagagaagcgaggcggatgccctggaagcacccagcatcacacccaggcttgtgcggggccaggctgggagcccatgcagtagggcagaaggcagcggaggccaggtctgtcccggctggagaacagcgtccacgcagtcctgcctggggtcaggccctcactgaccctcaggggagcccccaaggtgctgtctgtctagacaggctgtcccaccccagggtggctagtggccatatgcagggaatggtgcttctggctgtggcacgcactggatcacccaggtcccagcagacatggccgcccaaagtcagcaagcctcctttgtgctatgtggagctcacagcctcacatgtgaacacccgtgtctgggttgcctggggtgatcctccctcctgcgtggtggctgtctctggaaagcatcccttgccgctgccacgggcagccccagcccccgtccgtccaggctcacccacagtagtgatgcagacgtgacgtgggggaagggggctgagccctgtggctgggttctgacaactgtaacggttttgtcgagcttaggcccctttggagggagaatcaataaataacaaacaccaactacaaacgccagt

SEQ ID NO: 350272 - DNA, 1224 bp, Homo sapiens
atcgctccagtcgcctccgacctcggcgctgggcgggcgcgccgggcctggggaaggggcgggcgcggggacccgatgcgcgggagcggaggccgagatggcttcggcgggaggcgaagactgcgagagccccgcgccggaggccgaccgtccgcaccagcggcccttcctgataggggtgagcggcggcactgccagcgggaagtcgaccgtgtgtgagaagatcatggagttgctgggacagaacgaggtggaacagcggcagcggaaggtggtcatcctgagccaggacaggttctacaaggtcctgacggcagagcagaaggccaaggccttgaaaggacagtacaattttgaccatccagatgcctttgataatgatttgatgcacaggactctgaagaacatcgtggagggcaaaacggtggaggtgccgacctatgattttgtgacacactcaaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagagttctccgggacgtgcgccgagggagggacctggagcagattctgacgcagtacaccaccttcgtgaagccggccttcgaggagttctgcctgccgctgcactttctgcctcacttcttggatcatggcctctcacacctggctgatgactgagtctgtgtcccccatttgccgatgacaccagcacctctgagcaccccagggccgcccctcctgctgttgcatctgtttctgagcatcttaaaatcacctttgaaggaaaagtcctcacaggaacacccccccttgtgccttacagacaaagaagtatgccgatgtgatcatcccacgaggagtggacaatatgggtaagaagctggcctgctgggctgtccccccgcccctcccagagcttgaggcagggacagttccaccagtgtgcagttactgagcactcccctgcgcacgcggcctgccagtgttgatctgcggcacagggttaaaatatgcttaaaaatgtatgtagctgggcgcggtggctcacactggtaatcccagcactttgggaggctgaggcagggggatcactggagcccaggagttcaacagcctggggaacatagcaaaaccccatctctaca

SEQ ID NO: 350273 - DNA, 457 bp, Homo sapiens
atgcctttgataatgatttgatgcacaggactctgaagaacatcgtggagggcaaaacggtggaggtgccgacctatgattttgtgacacactcaaggtaagcaggtggttctagggagggccgaggagaggggccagctaggacgtcccctcgggctcacacagacctgcctggcggcaggcctcccccggttggtttctgtgggtcccccaccccttcccacagtcagtgtccctgcaatggaagctgactgtgtgtgtggcctggagaccctgtgtctgcagcagagcccctttccccgtgcgcccctcaggttaccagagaccacggtggtctaccctgcggacgtggttctgtttgagggcatcttggtgttctacagccaggagatccgggacatgttccacctgcgcctcttcgtggacaccgactccgacgtcaggctgtctcgaagag

SEQ ID NO: 350274 - DNA, 529 bp, Homo sapiens
gcctttaaaacactctgtcccccccatatttcttggctgcagactctttgatcacattttcgtgtgacagtgattttgtaatatttcctatggggagaatagaaagataattccgtctctcctttggcagtaggcatgtccctgtgagggaggagatcagcaggatttttccaagcacctgtcaaaaccctgctgatcaaaacagaacataacaataacaaagaatggccaaaaccagctcggaataggaattaaaatgcatttgcataagatactcccaccagggccatgacagtttacaaatgatcccacggcaataacccaggaattatcttatatggttccaggaacttcctgttcctagtttatgaataacctgcctcttatttagcatataattagcagtgggtataaatatagctagccagcaatcctggagtgctattctacctgtggggtagccctgctctgtctgtggagcagccattttgctgtacaatgttgctttaataaacttgctttgctttca

SEQ ID NO: 350275 - DNA, 331 bp, Homo sapiens
agtccacattcacatatataaataattgaataaataaatggtgtgaaaggacagctattccttggagaagaattataattaataaatatagaaggaatgagggaaatatcaaatcaccattaggcaaacaccattgtaatcatggttgcaggcaagacccaccaatggatactaaaatcagtaggtaaaagttggagtagaaacaggattttttcataatctcaaaatatttcctcctgcaggagcgttaacaattacaaagagaaaaagagtaatgttatagtggagaaacctagcagacaacagtttaaccttaaccttaagtgatcaa

SEQ ID NO: 350276 - DNA, 817 bp, Homo sapiens
ggaggtgtggacggctcaccctgggtggcccagaggatgcgggagctcaggggacacacagctgcactaaaggtcccgtgtggtgtcgactccccggcccgccaggaggacggctgtgcaaccccttcctgcacccttgcctaagctgcagaggctggtgatctagctcctgctgttaaactgtggtgtacacagacagaatcaggtccaaggagtcgcttctgtgaaggttacaaggtgaggacaactgtcacatttggggggaaatagtaaaacgctatgattctgcactgggttgcgttggaaacatctctaagttcctcaggctctgtcttccctcaaactcccactgtccacggtggggccagcagtgaagtggggggctcctcaggtctccagtttttccctgactctggtcacacccctcaccccagcctgtgccccaggtcactgccccctccacgcccccagactcggggatgggtataactggcctccaagctgcccacctccacccggtgatggcactggaggggccaccacaggactcttgtgatggggaccacatgccaggccaggccatcaaccccgcacctctgcgacctccctggagccggggtcccctcgcggggccaccacgctgggaagtcagcggggcaggtgccagagcggggtagccaaccccacccaaagggaaggcctgcagggccctgaaggcagctccactgccacacatgcccagggtgctggcggggaaatgtgtcccaaaaaacaggcacctccaaaaacgtcaggtgaaccccgacgccccgtggag

SEQ ID NO: 350277 - DNA, 772 bp, Homo sapiens
ggaggtgtggacggctcaccctgggtggcccagaggatgcgggagctcaggggacacacagctgcactaaaggtcccgtgtggtgtcgactccccggcccgccaggaggacggctgtgcaaccccttcctgcacccttgcctaagctgcagaggctggtgatctagctcctgctgttaaactgtggtgtacacagacagaatcaggtccaaggagtcgcttctgtgaaggttacaaggctctggaagtggacgctaaaccaggccgtgaagccgtgcagggtccccgccttcctgatgtcgaagcgcagctcgcccctcagggtctgggtcaagcagatgacaaggcacgcgtgggcaccgcgtggcaccgcagggcccgggttggggcggccccctccacgcgccccgcgcagacgctgaatgcgtcaggaaccgtagaaaagccccccagcctggggaaaccacccccaaaacccgcatcgtgagttcagaggcttcagtcagaaacgtttcaagcatctgagcttcttgcgcccaattttctaccccagattctgcggaatcttttcggcgctcagctcttccagttaaggagttggagagctccaggctgggcctttccacagcagaacgaactaaaaaccaaagcgcgccggcgccaccgcgcccgccccatctccagacgcggcgccagctggggcgccaggcagggcgggggcgcggggaaaccgcccagagcccacgagcgccaccgcgcggccacagacaggg

SEQ ID NO: 350278 - DNA, 1003 bp, Homo sapiens
ttctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagcagctctcccagcattttgggaacaaatcaggtcattatctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattcacagaactgtctcggaaagccctggtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggagg

SEQ ID NO: 350279 - DNA, 534 bp, Homo sapiens
agcccggggcggaacgggggaccctctctgaagcggctctccgtggagttggatgttgcccttcgcgggagggagtggcggtcaagacccctttatcctcggccccagaggggcaggtggcctcgggtcgccctccgccaactccgaggtttggggaaaggtgctgctgaagcaatggaagaaaaatcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggagg

SEQ ID NO: 350280 - DNA, 886 bp, Homo sapiens
ggagcagccggggcttcgccggcccgcgccgttcttctcacgcgccgctccggggcgcagccacagctgtcgcccaccgcgggtgagaggcttgctggtccgccccggcttccccgccccggcggcggccgtgcggttcgggctttaattctggcgcttgccagccggggccgactccgccccctgcgccccgcccttccccgagctccgggtccgcggcggagcgagcgagcggccggcaggttgggaggagcggccgaagggtctcactctgtcacctgagctggagtgcagtggtgcgatcacagcttactgcagcattgaactcctgggctcaagtgatcctcttgcctcagcctcccaagtaactgtgactgcagtgtccttgctggccttgcaaaatgagtttggaagggttgattccatcctcttcagttgtggaaagagtttaagaagggtggtgttaattcttctctttaaatatttgatgaaattcaccagtgaagccgtgacatcctgggatattctttgttgagagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggagg

SEQ ID NO: 350281 - DNA, 753 bp, Homo sapiens
gcgggcgcctggctaccccggcccggcgctctgtccctcggatgcctctgggcccttccctagcccggggcggaacgggggaccctctctgaagcggctctccgtggagttggatgttgcccttcgcgggagggagtggcggtcaagacccctttatcctcggccccagaggggcaggtggcctcgggtcgccctccgccaactccgaggtggcttcggccggggctggagggcggggaggcgggggaggggcgtgggcgctgcggcctctggggcggcccaacccggcgcgggcagcgtgggtttccgaggtcccgcggttccaggtcgagggaaggtgtaggggccctgaagcgggctggtccccgaatgttgcgttttctgtgccgctttgggcaacacgcagtggcgctcgcggcagccacggctccttgaccgttcatctccttcacccgggtcccgtggaactttcagaggcaactgttcttggtggctcttgcgggtcagcacgagccgtgctgcacgagcgtgacctagtgaaggccttgggcgagttggcgttaacaatttatggcgtccgccagcgctcgctttccgcacgtggcctctgcggagggtcagcccatcttattaaatagtggattctattagaccctgatacccgaggctaataaggaagcttaatcatccagatgtgtaatcgtgcagttcctttcctcaccgtcattgccccccacctctggagctgaatgg

SEQ ID NO: 350282 - DNA, 969 bp, Homo sapiens
ggagcagccggggcttcgccggcccgcgccgttcttctcacgcgccgctccggggcgcagccacagctgtcgcccaccgcgggtgagaggcttgctggtccgccccggcttccccgccccggcggcggccgtgcggttcgggctttaattctggcgcttgccagccggggccgactccgccccctgcgccccgcccttccccgagctccgggtccgcggcggagcgagcgagcggccggcaggttgggaggagcggccgaagggtctcactctgtcacctgagctggagtgcagtggtgcgatcacagcttactgcagcattgaactcctgggctcaagtgatcctcttgcctcagcctcccaagtaactgtgactgcagtgtccttgctggccttgcaaaatgagtttggaagggttgattccatcctcttcagttgtggaaagagtttaagaagggtggtgttaattcttctctttaaatatttgatgaaattcaccagtgaagccgtgacatcctgggatattctttgttgagagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggagg

SEQ ID NO: 350283 - DNA, 213 bp, Homo sapiens
gggaaagacaggccaaaccaaggatggcaaatgtgatgcacacagcaccacttccatgtccgtgacaggcaccaataagcaattggagcacactctcaccaagcttcaaaagtctctctttttttttttttttttttttttttttttttttgagacggagtctccctgtgttggccaggctggagtgcaatggcgcaatctcggctcactgca

SEQ ID NO: 350284 - DNA, 633 bp, Homo sapiens
atgtataggtaactatttgtaagctatcagaatttcagaaggaactgtactgttagttatcaaataatttacgatagccctattacacacaaatctaaaactatacttgttagatctttattaatatttgggatagtctctttactaagagaaaactcacaaaattaaaccacttaaatttttggaatttatttttagatttccctttcagctccagtcttgacttttaaatttatataattaaagagccattgcattacatttatgacgaatatgacacataataagggacaatagctgaccggaagaacattgttatcaagaaaatttgttttaattcagatgactaaatgtagaaaagtatttcactttaatacaattttataaagaggttaagtttatgttgtgttttaatcacaaagaaaacagagtttcccccttattctatctatttgataactaaccattggttattgaatgaaattaagtggaactgatttctcctttctcaaaatattcttagagtacatatggggttttaagaagtaagatgtgtctttgtgtgtgtgtgtgtaatatttttaacttaagtgaagaatgcaaacatgaaaaactagaattatttcttgtgta

SEQ ID NO: 350285 - DNA, 367 bp, Homo sapiens
atagaatttgtggtaaacaagttttttttaagtactcttgaatttcagcttctataactggctgttcagctactgatacacaaccaaatctgttttatagagagagagagagtgaggaatggggatttttatatcattttgtttttaaactgctttagcctagaaatgtaactgtgtaactgtcttttttgcttatgtctccactacctctattcttatttttaacattcatcttatttttatttcttctggaatattgtgtttttgacactcactatctccctattttggctcctgttattttactatatgtcagttttcataaatgatatatattatcttttttttggagtcttgctctatcgcc

SEQ ID NO: 350286 - DNA, 743 bp, Homo sapiens
  misc_feature (690)..(690): n is a, c, g, or t
agccgcggtgtgagggagcgggagtcttccttagcttctccgccatgggtgtcgcttcgtagccgggctgctccgggaaaggcctcgtacagcacgcattcaccagaatcctgtcagctttcctcttctcatccagacgcctggccaggatcctcgataagaccgtgacccccaacttggacaccccataagctttgttctcagaaacttggcggctacaaggaattaaatgtgaatgggaaaggaagaaagaaaaacacagatcatagaagctgtgccttcgaggaaataaatcctcttaaggggaggaggtgtcctctttgatctgagggcacacctctgggagagaggccagaggctgacagtcagcctcgtcagccagatgcgtcatcagccctgggaagggctgcacccacaccaccctccactgaggtccaggtggccccaccggtcccgaaacacctgctgccttactctagaaagagtaggcaagttgcgccctctagtggcttagtagttgcttgtcctattgactcagaaccttgaacaaataagcaagtcaaatacagatagatggtccctgccctctgatggttccacttaggacttactgacttcactgatggatgaggaagcgatatgcattctgcagaatctgtacttggaggccccatacaaccattctgcatntcactttcagtacagattcaataaattacataagatactcaacattttatgat

SEQ ID NO: 350287 - DNA, 1383 bp, Homo sapiens
gaactttgggaggccaagttgggcagatcacctgaggtcaggagttcgagaccagcctggccaacatggtgaaataccgtctctactaaaattacaaaaattagccaggcatgatggcagatgcctggtaatcccagctactcaggaggctgaggcaggagaacagcttgaacccaggtggcagaggttgcagtgagctgagatcatgccactgcactccagcctgggcaacaagagcgagactccgtctcaaaaaaaaaaagaacagaaataatcaaaccacagcatcaattcattcattcattccaccaacatttattaagcagcaagctccgaagcagacgtttaccagttttgcacaactttgtcatggaccaactggccttgtggctcagtggcatctggaggcaagagggccaagtagacaggggtctcagccccctcctccacagtcctgatgctgtctttcccatccatgtctgtcttcactggtcctgggcagcacgcattcaccagaatcctgtcagctttcctcttctcatccagacgcctggccaggatcctcgataagaccgtgacccccaacttggacaccccataaggttcccagatgatgtgacagctactggtctccagccacaccttgagaacacttggctttgactaccacttcttaaacttaaaggaaaactagacaatccaccagcccaggaggggacaagcaggcttattcctcctcctcgtcatctctggctccagccccaccctggcccttgctggcattcttcctcttcacgtggctggggttggccaccccaatagggaagcagagggagaagtcaatgtgcttctgggaatccaggcggacagtgaagaacaggatatttaccacctgctcacggacacggatatgacactgctgaatcagcacatgagcgtggcggatggacttagccaagccaagcttgaagacctgggtctgtaggaatctctaagaaatcattgatcttcaggcccaggatgtaatccagcttcatcttgccctcatccagcaccccagtgcggaccagccactgcagcagggcaatgccttcgaacagacgccgtgggtccttctcatcaagcgtcagcagctcccgggcggccttatggatcttgaccagggtaaatttgaccctccagacctcacatttgttctggagcccatactcaccaatcagctttagcttttggtcgagatgaggtttctcgaagggtctctgcagggtcacataagtttggcgacaaacccagctctgggccgctggcatgttggctccacttgcccgtctatgcctaagcacaggccctggtcactgagaaagagctcaaattttttatata

SEQ ID NO: 350288 - DNA, 965 bp, Homo sapiens
agccgcggtgtgagggagcgggagtcttccttagcttctccgccatgggtgtcgcttcgtagccgggctgctccgggaaaggcctcgtacagcacgcattcaccagaatcctgtcagctttcctcttctcatccagacgcctggccaggatcctcgataagaccgtgacccccaacttggacaccccataagggtcttctctgtcgcccaggctggagtgcagtgctgcagtcgtggctcactgtagcgtcagtctcctgagctcaggaaaactagacaatccaccagcccaggaggggacaagcaggcttattcctcctcctcgtcatctctggctccagccccaccctggcccttgctggcattcttcctcttcacgtggctggggttggccaccccaatagggaagcagagggagaagtcaatgtgcttctgggaatccaggcggacagtgaagaacaggatatttaccacctgctcacggacacggatatgacactgctgaatcagcacatgagcgtggcggatggacttagccaagccaagcttgaagacctgggtctgtaggaatctctaagaaatcattgatcttcaggcccaggatgtaatccagcttcatcttgccctcatccagcaccccagtgcggaccagccactgcagcagggcaatgccttcgaacagacgccgtgggtccttctcatcaagcgtcagcagctcccgggcggccttatggatcttgaccagggtaaatttgaccctccagacctcacatttgttctggagcccatactcaccaatcagctttagcttttggtcgagatgaggtttctcgaagggtctctgcagggtcacataagtttggcgacaaacccagctctgggccgctggcatgttggctccacttgcccgtctatgcctaagcacaggccctggtcactgagaaagagctcaaattttttatata

SEQ ID NO: 350289 - DNA, 890 bp, Homo sapiens
agccgcggtgtgagggagcgggagtcttccttagcttctccgccatgggtgtcgcttcgtagccgggctgctccgggaaaggcctcgtacagcacgcattcaccagaatcctgtcagctttcctcttctcatccagacgcctggccaggatcctcgataagaccgtgacccccaacttggacaccccataaggaaaactagacaatccaccagcccaggaggggacaagcaggcttattcctcctcctcgtcatctctggctccagccccaccctggcccttgctggcattcttcctcttcacgtggctggggttggccaccccaatagggaagcagagggagaagtcaatgtgcttctgggaatccaggcggacagtgaagaacaggatatttaccacctgctcacggacacggatatgacactgctgaatcagcacatgagcgtggcggatggacttagccaagccaagcttgaagacctgggtctgtaggaatctctaagaaatcattgatcttcaggcccaggatgtaatccagcttcatcttgccctcatccagcaccccagtgcggaccagccactgcagcagggcaatgccttcgaacagacgccgtgggtccttctcatcaagcgtcagcagctcccgggcggccttatggatcttgaccagggtaaatttgaccctccagacctcacatttgttctggagcccatactcaccaatcagctttagcttttggtcgagatgaggtttctcgaagggtctctgcagggtcacataagtttggcgacaaacccagctctgggccgctggcatgttggctccacttgcccgtctatgcctaagcacaggccctggtcactgagaaagagctcaaattttttatata

SEQ ID NO: 350290 - DNA, 948 bp, Homo sapiens
gcctgcggctggccacctccgcaccctcggagcgctccagggggccccaacccaagccctgcacctactcttgaaggcgacggccgcgttgttgaccagtacgttgagccccccgtactccttgcgcaggaagtcgcgcagggcgcggatgctctgcaagtcgtcgatgtccagttggtggaagcgcgggctcaggccctccgcctgcagctgctgcacggccgcctggccccgcgccacgtcccgcgcggaaaactagacaatccaccagcccaggaggggacaagcaggcttattcctcctcctcgtcatctctggctccagccccaccctggcccttgctggcattcttcctcttcacgtggctggggttggccaccccaatagggaagcagagggagaagtcaatgtgcttctgggaatccaggcggacagtgaagaacaggatatttaccacctgctcacggacacggatatgacactgctgaatcagcacatgagcgtggcggatggacttagccaagccaagcttgaagacctgggtctgtaggaatctctaagaaatcattgatcttcaggcccaggatgtaatccagcttcatcttgccctcatccagcaccccagtgcggaccagccactgcagcagggcaatgccttcgaacagacgccgtgggtccttctcatcaagcgtcagcagctcccgggcggccttatggatcttgaccagggtaaatttgaccctccagacctcacatttgttctggagcccatactcaccaatcagctttagcttttggtcgagatgaggtttctcgaagggtctctgcagggtcacataagtttggcgacaaacccagctctgggccgctggcatgttggctccacttgcccgtctatgcctaagcacaggccctggtcactgagaaagagctcaaattttttatata

SEQ ID NO: 350291 - DNA, 266 bp, Homo sapiens
tctggattccacctcgatctccacggtgctcaaagcagctctagggggagtctgccaggagggaggtagagttgggggcggcgaaggacctggagctaagcgctgaggctcaggccctcaggaacaacggcttcagaggcaacagcacaaagcaggccaagtgctgggccaggctgggatttagggagagcccctggctgaggaggggagcggagacactcggggacatggatgacagggtggccaccaagcactgcagcccccac

SEQ ID NO: 350292 - DNA, 801 bp, Homo sapiens
aaaattgtctcatttaatttcatctttatgataatctcatgaagtagggattgtcatacacatttggccatgggtaagtggtaaaattactactatagcccaggtaaatctgatggtaagatctttgattttaaatgataaaattgtatgatacaaaagaaccaaagccaaaggaagcaaaaataattcctataggttttaaagtgatattttgattttaaaatattaaaatagtattgcaagggactattaagctaaattatgatactcttcttttacatagacttgttaacctactaaattaagtgggagaagttaaaaacatgtttggtttagttgagagactgatattgggaaaaaagatagccagactctgagacaaaacagattatgctcagttatactgacccagtcaccctttaaaagaacattaaataataataatattaattatatatgatgtatattaaatattctgacttcagatacagatctcttcagctcaccaaaactcatatatttgttttctgaaggatttcatcttgttctttactagctgccaattaatcacacactttttaatttaatctgggccctcttctgtctgcctgcccagtgctggtaggagtgtattcgtccaagacctatggacttcttatttttggttaaatatgtgctcccagctcttcctcttcatcttctttctggggtactattattgtttttagacaaaatggcataatatgcagggggatgggttttgtataaaataaaacagggttcaaatcctgggtctgcatg

SEQ ID NO: 350293 - DNA, 366 bp, Homo sapiens
cctcccaaagtgctgggacttaggcatgacccactgcacccagcctcaatgttgtcttctgatgaatagtgaataatttttgtgtcctgttgaagaattctttgcctccaacaaattcgcgaagataattctatttctctccatatcccgtttattgaaaagaccattcttactggactgtagcatcacttgtcaagcaggtgtctatatatgtgttggtcagtttctgaactctgttctcttccatgaacccatttgactatccttgaaccagtgctactctatcttaataagtacagcttcacggtaagtcttgataactggtgcacagatcctctgactttgcatttcttctgtattgttttg

SEQ ID NO: 350294 - DNA, 232 bp, Homo sapiens
aaagggcatccaaattagtaaagaggaagtcaaactgttgctgtttgctgatgatttgatcatttacctagaaaaccctaaagactgctccagaaagctcctagaactgataaaagaatttagcaaagtttccagatacaaaattagtgtacacaaatcaatagctcttctatacaccaagactgaccaagctgaaaatcaatcaagaactcaaccccttttacaatagctg

SEQ ID NO: 350295 - DNA, 914 bp, Homo sapiens
aaataaacaaaaaaaatccattcatttactcatgcaataaattctcctgcaagcttttatgggcactcagtaagtactcaggattggctttatcagccttgccactgagcagctcatggtcctatggaacctgagccaggcctcagtctctccatgattggctcagctaactctcagttcagagtggagagtatcaatcttgtgtttttgcccttaggcagcactatatgagacatggggcctgtggtccttccttctggtgtcccccgtgttaaaagataaaaaacaccccaagggccgggcgcggtggctcatgcctgtaatcccagcactttgggaggctgaggcgggtggatcacgaggtcaggtgatcgaaaccatcctggctaagacggtgaaaccccgtctctactaaaaatacaaaaaattagctgggtgtggtggtgggcgcctgtagtcccagctgctcgggaggctgaggcaggagaatggcgtgaacccgggaggcggagcttgcagtgagcagagatcacgccactgcactccagcctgggtgacagtgcaagactctgtctcaaaaaaaaaaaaaaacactccaagggccatccgtgctctctgcccctcctgtggggaccaagtggggttaggaatggctcagtggggaaggagagcactcttgtccccagtcccttgccaccctgtcccttagatagggaggtgggctgcagagattggtgccagaagagggtgggtttgggaattggagctcctccaaggagctcctcctaagattgagtgctgcagctgtagtggctgctggttgggagagtaagtgccatcactaatttaaaagtccttgccatctggaatcaggctttgtcaacagcagctgagaaaagcagcctgtgcctctg

SEQ ID NO: 350296 - DNA, 3801 bp, Homo sapiens
gcagggagccaggctggggccatgggctgctgccagaggaccgtggatacctcagtgtccacacacccaccatgcccagccctggagccatcactactcacaccgtggtcctgggccagggcctgagatgacagtggggagcaccatcctcattaatgtccaagtcacagggagcctcagccttgccctggctggggttgtggtgactccagtggaacattccctgatgggggacatgccgtggtggagaacacacctgtggctatcttatgtgaggactagaggtgaagaggagatggacactgcctctggagccagcctgacaccaaggacagcacttgtcatcatccctatcctcgtcagccccaccctactgcctcagctggacccagggctttgacacaaacccagtgctttgcttatgggtgctcgctggggtccggtggagactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgtgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacgcattcctcctcagctccacccacctggagacgaatgtagccagagaggaggaaggagggaaactgaagacaccgtggcccctcggccttctctctgctagagttgccgctcagaggcttcagcctgacttccagcggtcccaagaacacctactaattcctctgcactccttcatggctgggacagttactggttcatatgcaagtaaagatgacaatttactcaacaaatatttatcgagcaccttttatgtaccaggcactgttgtaggtgcttaggatattctcatgtttctgagggattacagcctgggaggattccaccgatcttcacttctagcaggttttttaaacgtgacccttggctgtatttcccatcttcacagttcaagcaccccaaacctgccctttctcccctgcagactggcaggtgggattggctcccaggtcatttcctctctctctctttctcccaagcctttctccctccacaggaaacagatttttcagggccttccatgcctgccactttgtccgtctctttttttttttttaaagtaatattttttagaaatacatgtaaaataccaagaaataatgtctgcgcctctgccacctctctctcatctcttatttcataaagctggctctttatgttgctttacatgccttaatatatgttttatggagattatacatattatagatctatatatgtaatatatttgtttggatgtctgatcttttcctacagttcctgcccaggcctgtttttctctcccttattttccacatcattcctagcatatcaagaccataccccttgcctttttgatccaaagaaggggagaggaaagacttattttaagacatctattttatgcttttgtttaaaaaaagcaaatctattttcaaattgtgcaatgtctgaatggaattggcaaatgaggtgaggagatggggtaactgcctttaggtcccaaccctgtgcctgtccctctgccacagtggcttccttccatcctattccccagtcacgaaagggctggtccccagagctcacccagaaagcatcttgccgggggcagggcattccctcggaagtcctggcctaaggattttattacactgtctgctcctgatgaccctctgcggttgtcaggcgtgaatcctctggaaggaactgtttgcagttgtatgcacaaaggagacccatgcaggcatgcaccccagatgggctgctagactacccctcttcatcagcctgctggaaagagcagacagcgtaacagcagcctatgccaaacagcactaaggatgtcagtgtacgagacggtgcgaagcccagaggaggcggcttgggatcctctgggccatccctggccctgtagcacagacacatacaagttccttggacttgtcacactccttttcacttgatccctctctggcctgggtcacatttatgacatcccccctctgcaacctttctctctgggggctgtaccaaaggcatggtacctcagtctggtatccagactgtgaaatcagcctctgggccaaggagggtcctacagacaaggtggcatctcaacctcacccaagaaacccccgggactttaccccagcaggctgccactggggcaccgaactaagccagctcagccttccaagctgcttagcctttgtcaaccatcaaagtggggaaagggtctctggccttgcaaggatttgggcaggatggaagtctttgtctaggtctgaaatcaagggcttgggaatctagagcagagctcctggccagcgtttgaagcctggcctcccacctggggcatttactgacaccctgtcgccagcctagaacatcctgctctgaatgaacagagcccagatgggggtccagagctaagtgacccacctggggaagctctgattattcatccagggccttctcaatgagcacattacctccatgatcaataaccaagaggctgcagtcaaatactgctactgtcactttgaagattttctaagggcacaagtggcacacttgctctccggcctttgggagaggcatgttcttgggcagggctggctacggcaagagggaaccaattcctttcccctttaggcaccctctacctggcagctcttaaaactaagaaaaaatatgatatacacacacattatatatatatatatatatacacacacacacacacacacacgtatatctatttatgcacatattggggccaatttgatttgctagtattagacaataaactgtacaaggaaatttattatctcagtgtctttatttagcataaaagtggccttagaagaagggtgaaggttagatagatggaatctctgtcaggggacaaacagctgtagcatccccttagcatctttctagccaatgagccccctccccaggaggagggatggcctgactgaaacaggtgagagtttgcttccccctttcagcagcattctttttagatttaggtactgaagaatcccagtgagttctgcatttgtatcttgcaagtttgtataaacccaatacaggaaataaaatgaatggtttgtata

SEQ ID NO: 350297 - DNA, 3472 bp, Homo sapiens
ccaccctgcttgagccaaagacaaggtggtcagtctccaccggaccccagcgagcacccataagcaaagcactgggtttgtgtcaaagccctgggtccagctgaggcagtagggtggggactgaccaccctgcttgagccaaagacaaggtgatgagagatggggagaggccattggctcccagagggaacagtgctggctgtggctagagaacagcaggtctgtgcagtgtctgagggcaggttgggaagggtagcagagagagagagacagaaagagagagagagagagagagagagagatcctcagagtggaaggagggggaagcagcaggacacattggcaagtcaagcaggaaggagggagatggaaaggggatatcagattggtttcccccggtggagccttaggttagtgcccagtgcagtgccagactgtctcctctgctcctcccacctcatccctaggaggacccaccagtggagcacatgcagcctcagtggagatgcttggtgtggggatctgggtgaagggggttgagtagcgactgcctgggagatggctgttagtaggtctgtgcctggtgtctgcctcgccatcctggggtaaggggcagagagaaggacttgtcttatgtagggtgtggtcagccttggggccttacctacccagttccatgatatttcttgccctgttccccctggaatgtgcagtgggccagctgagagtacgccttgaggaggggggatgaggccttaatctgggaggcctatccccctatcccaggcatcccagacgaggactggctgaggctaggcgctctcatgatccacctgccccgggagggcagcggggaagacagagaaaagcaaacgcattcctcctcagctccacccacctggagacgaatgtagccagagaggaggaaggagggaaactgaagacaccgtggcccctcggccttctctctgctagagttgccgctcagaggcttcagcctgacttccagcggtcccaagaacacctactaattcctctgcactccttcatggctgggacagttactggttcatatgcaagtaaagatgacaatttactcaacaaatatttatcgagcaccttttatgtaccaggcactgttgtaggtgcttaggatattctcatgtttctgagggattacagcctgggaggattccaccgatcttcacttctagcaggttttttaaacgtgacccttggctgtatttcccatcttcacagttcaagcaccccaaacctgccctttctcccctgcagactggcaggtgggattggctcccaggtcatttcctctctctctctttctcccaagcctttctccctccacaggaaacagatttttcagggccttccatgcctgccactttgtccgtctctttttttttttttaaagtaatattttttagaaatacatgtaaaataccaagaaataatgtctgcgcctctgccacctctctctcatctcttatttcataaagctggctctttatgttgctttacatgccttaatatatgttttatggagattatacatattatagatctatatatgtaatatatttgtttggatgtctgatcttttcctacagttcctgcccaggcctgtttttctctcccttattttccacatcattcctagcatatcaagaccataccccttgcctttttgatccaaagaaggggagaggaaagacttattttaagacatctattttatgcttttgtttaaaaaaagcaaatctattttcaaattgtgcaatgtctgaatggaattggcaaatgaggtgaggagatggggtaactgcctttaggtcccaaccctgtgcctgtccctctgccacagtggcttccttccatcctattccccagtcacgaaagggctggtccccagagctcacccagaaagcatcttgccgggggcagggcattccctcggaagtcctggcctaaggattttattacactgtctgctcctgatgaccctctgcggttgtcaggcgtgaatcctctggaaggaactgtttgcagttgtatgcacaaaggagacccatgcaggcatgcaccccagatgggctgctagactacccctcttcatcagcctgctggaaagagcagacagcgtaacagcagcctatgccaaacagcactaaggatgtcagtgtacgagacggtgcgaagcccagaggaggcggcttgggatcctctgggccatccctggccctgtagcacagacacatacaagttccttggacttgtcacactccttttcacttgatccctctctggcctgggtcacatttatgacatcccccctctgcaacctttctctctgggggctgtaccaaaggcatggtacctcagtctggtatccagactgtgaaatcagcctctgggccaaggagggtcctacagacaaggtggcatctcaacctcacccaagaaacccccgggactttaccccagcaggctgccactggggcaccgaactaagccagctcagccttccaagctgcttagcctttgtcaaccatcaaagtggggaaagggtctctggccttgcaaggatttgggcaggatggaagtctttgtctaggtctgaaatcaagggcttgggaatctagagcagagctcctggccagcgtttgaagcctggcctcccacctggggcatttactgacaccctgtcgccagcctagaacatcctgctctgaatgaacagagcccagatgggggtccagagctaagtgacccacctggggaagctctgattattcatccagggccttctcaatgagcacattacctccatgatcaataaccaagaggctgcagtcaaatactgctactgtcactttgaagattttctaagggcacaagtggcacacttgctctccggcctttgggagaggcatgttcttgggcagggctggctacggcaagagggaaccaattcctttcccctttaggcaccctctacctggcagctcttaaaactaagaaaaaatatgatatacacacacattatatatatatatatatatacacacacacacacacacacacgtatatctatttatgcacatattggggccaatttgatttgctagtattagacaataaactgtacaaggaaatttattatctcagtgtctttatttagcataaaagtggccttagaagaagggtgaaggttagatagatggaatctctgtcaggggacaaacagctgtagcatccccttagcatctttctagccaatgagccccctccccaggaggagggatggcctgactgaaacaggtgagagtttgcttccccctttcagcagcattctttttagatttaggtactgaagaatcccagtgagttctgcatttgtatcttgcaagtttgtataaacccaatacaggaaataaaatgaatggtttgtata

SEQ ID NO: 350298 - DNA, 444 bp, Homo sapiens
gggggaggaggggaaaggggagagggagagggagaaggagagggagaaggatagggaggagagggagaaggagaaggagagggagaaggaggagagggagaagaaggaggagaaggaggaggaggaggagaaggagaagaagaagaagaggaagaggaaaaggaagaagaaggagaagaaggagaagaagaaggaggaggaggagaagaagaaggaggaggaggaggaggaggagaagaagaagaagaggaagaagaaagaagaagaagaaacaattgctaaagacatcatgtctagatgtgcagtctaacttcaaaatatgaagacaacatatttcctacaatcaacaaaagcagctttggccccaaattctaaaaccaaagacgatttagagtattaaataaaaggttcacctctaccacaaattgaccaggaaaatgaact

SEQ ID NO: 350299 - DNA, 570 bp, Homo sapiens
ctttatagtttaattttaagggggaaattggttattttcaattattaaaggttaaaataggccaaatcactttttatgcaatcatgttttatacagtggtctcattgcacattgtgttttttctgcactttttacggtatccttatcatgctggtatgtcaatatacaccctaaagaaaaactccatttaatgattgtgccttgtattctattattttttgcatcattagtaaaattaagttgtctattgtaaatgataactatatgacttaggagaatgtattgctatatgtactgctatggaaaaggaaagcagttatttatttgtttatggtacagttagttattttataccttaaaaaccaacatacttaccatttctattgtttaaaaattactgtccatttttttaaaaatttaaagaatgtagtattttctgaggactggtatggtacaaaaatgtaatcaaaattttcagatactacatttttaaaaagtgaggatggggaaaatatgtatcagcatgaccctgatgtagaaaaataaagtctgcaattgaaccttgcaaaa

SEQ ID NO: 350300 - DNA, 299 bp, Homo sapiens
gagcctcctacatggtgctgcttctagtcggccgtcttggccccacccctagttttgcatggctgggaggcctcaggaaacttaaaatcatggcgcaaggcaaagggaaagcaacgcaccttcttcacaaggcagcaggagggagctggagtgattttctaagaataattctggccaaactttcatgcactcccgcagccaaactccatttggatctattcaggcaggaatcatatttcagctccttaactctcataagtggaaactgacaccaactcattataaaacctaagtggaaa

SEQ ID NO: 350301 - DNA, 725 bp, Homo sapiens
agcaaatatatatttcaagatgaatctaaagcagtttttaaattacctgaattttctgtgtattaaaaaaatgtaatcttagaagctgtccagttactcagcttatagtaactgaaatgacaattctactgtaaatacttaaaaaatgaataaaacagtatggccacaactccaaggggcatttacaggttaatgaaatttgttgaacatcaatagctgctagaagagaaagtattaactaattttgaaagtcttgccttttctagcaagaaggtagctaacgagctaagctaggatttgaactgataatgtgatgcaaaggccaagttgtatcactatagaacacccctataacgctgcacaaaattagttgggttttcattgtgactttgccactgtatttgcattatgaacttaaacaaataattcatctggtttttgggttccttacaaggaatcaaaatatttggcctgttatatagttttgaagttatctttcagatctaatgtcatatgtccccaaacaccaggaaaaaaaattaacatctacaaaaaatttgatctatttaaactttaaaattcaataatgacaatatgaacttcacatacagattcatatacaaatatcctataggctgggcatggtggctcatgcctgtaatcccagcactttggaaggccgaggcaggtagatcacctgaggtcaggagttcaagaccagcctg

SEQ ID NO: 350302 - DNA, 695 bp, Homo sapiens
cgggacaacagatgacccggagaccgggggaggaccttcccatgcgcacgactcgcgatcttcccagtgccccagagccacggacccaaccgccgcctaccccagcccgcggcaccaaacctgttcacaactgcgactccttaggtccgcttggacaccgccggaaacggaaattcaccctcgcgccgacccgccggaggaaacaaaaaggcagaaaaaaagggaccgccgcctggacgacttgcaggggacagctggaagaaagactcgtcaacggccgagtgctggcgccggcgccgtctgcgcagtgcgttccaccggatgtgccgtttgggggtgctaaagctggtgttaagatctatcccaagaactataccgataacgaactggaaaagatcacaaggaggttcaccatggagctagcaaagaagggctttattgtctttgtatccagacaattctagcctcatggaatgagttgaggagtgttccttcctcttctgtttttggaaaagcttttgaaaggagtcacgtagcctttctctctccagtccacagatgtggggatctcaagaagcaggcgttcctggaactgtttcccgttcctgtgcttctggtattgaaaaccattcatcacctgcctgaattcttcagtggtcttcaaagaaaagtaaataaaatgttaagaagcaaga

SEQ ID NO: 350303 - DNA, 1748 bp, Homo sapiens
cgggacaacagatgacccggagaccgggggaggaccttcccatgcgcacgactcgcgatcttcccagtgccccagagccacggacccaaccgccgcctaccccagcccgcggcaccaaacctgttcacaactgcgactccttaggtccgcttggacaccgccggaaacggaaattcaccctcgcgccgacccgccggaggaaacaaaaaggcagaaaaaaagggaccgccgcctggacgacttgcaggggacagctggaagaaagactcgtcaacggccgagtgctggcgccggcgccgtctgcgcagtgcgttccaccgggtccgcgtccctcccgattcagccccaccccgccctcggaatccgctgcctcagctcctgctgtggcactccccagcagcttgcacctcgctcgcggagtccttgctgaaggccagggcagctgtgcggcctggcgcgggttacttgatgccgtgcaaaagccaggagacacatttggttctggccgccccggagtcaccgtgcccggggcgaatggactatggctggattgggagtccacttcctcctctgtaaagatgacagacgagggagatctcgcgttctgggggtgccctatagccctcttttggccagaagcggtggatcacgcctgtaatcccagccctttgggaggccgaggcaggaggattgcttgagcccaggagttcaagaccaatctgggcaacatagggaggctacatctctcaaaaaataaataaataaataaataaataaaaataaagccagcgtcgtggcggggcgcctgtggtccctgtggtcccagctactctggaggctgaggcgggacgatcgcttgagcctgggaggcagaagttgtagtgagctgagatcgagccactgcactccagcctgggcgacagagcaagacactgtctcaaagaaaaataaataaataaaataaggccctctttttccgggaccaacagactctgagggcagggacaaactgacccagcctaaactgcctcgccttccctgctcccgggaaaggggttttccctgagggaaggtagcatcttgccattttcttcctgcacagctttgccttcccagggatccacccattgccacctgaggaaatgccttggagcccatctaatccccagcccagctacttgggacgcctacagagactacattgtcagaggatgcatcttcctctagtcttggagggtttcttttcaatatgatcccaccggtgcatgcaaggctcaattctacatcaaaaaactaggcccactcctgtcaccgagacccccaggcttcaggtcctgtcacagtgaccttgttatcacccccagcagcccccagatgtgccgtttgggggtgctaaagctggtgttaagatctatcccaagaactataccgataacgaactggaaaagatcacaaggaggttcaccatggagctagcaaagaagggctttattgtctttgtatccagacaattctagcctcatggaatgagttgaggagtgttccttcctcttctgtttttggaaaagcttttgaaaggagtcacgtagcctttctctctccagtccacagatgtggggatctcaagaagcaggcgttcctggaactgtttcccgttcctgtgcttctggtattgaaaaccattcatcacctgcctgaattcttcagtggtcttcaaagaaaagtaaataaaatgttaagaagcaaga

SEQ ID NO: 350304 - DNA, 322 bp, Homo sapiens
gatttttatatcttttttatttttattgttttcttattttacaggataacgaactggaaaagatcacaaggaggttcaccatggagctagcaaagaagggctttattggtatgtgtagccacatagattttggcataaagtgggaacatctaaaaaaatcttttttttttttttttttttttgttttgttttgttttgtttttgagacagagtcttactctgtctcccagactggagtgcagtggtgcaatctcctccacctcccgggttcaagcaattctcttgtctcagcctcccaagtagctgagactacaggcatgtg

SEQ ID NO: 350305 - DNA, 1722 bp, Homo sapiens
cgggacaacagatgacccggagaccgggggaggaccttcccatgcgcacgactcgcgatcttcccagtgccccagagccacggacccaaccgccgcctaccccagcccgcggcaccaaacctgttcacaactgcgactccttaggtccgcttggacaccgccggaaacggaaattcaccctcgcgccgacccgccggaggaaacaaaaaggcagaaaaaaagggaccgccgcctggacgacttgcaggggacagctggaagaaagactcgtcaacggccgagtgctggcgccggcgccgtctgcgcagtgcgttccaccgggtccgcgtccctcccgattcagccccaccccgccctcggaatccgctgcctcagctcctgctgtggcactccccagcagcttgcacctcgctcgcggagtccttgctgaaggccagggcagctgtgcggcctggcgcgggttacttgatgccgtgcaaaagccaggagacacatttggttctggccgccccggagtcaccgtgcccggggcgaatggactatggctggattgggagtccacttcctcctctgtaaagatgacagacgagggagatctcgcgttctgggggtgccctatagccctcttttggccagaagcggtggatcacgcctgtaatcccagccctttgggaggccgaggcaggaggattgcttgagcccaggagttcaagaccaatctgggcaacatagggaggctacatctctcaaaaaataaataaataaataaataaataaaaataaagccagcgtcgtggcggggcgcctgtggtccctgtggtcccagctactctggaggctgaggcgggacgatcgcttgagcctgggaggcagaagttgtagtgagctgagatcgagccactgcactccagcctgggcgacagagcaagacactgtctcaaagaaaaataaataaataaaataaggccctctttttccgggaccaacagactctgagggcagggacaaactgacccagcctaaactgcctcgccttccctgctcccgggaaaggggttttccctgagggaaggtagcatcttgccattttcttcctgcacagctttgccttcccagggatccacccattgccacctgaggaaatgccttggagcccatctaatccccagcccagctacttgggacgcctacagagactacattgtcagaggatgcatcttcctctagtcttggagggtttcttttcaatatgatcccaccggtgcatgcaaggctcaattctacatcaaaaaactaggcccactcctgtcaccgagacccccaggcttcaggtcctgtcacagtgaccttgttatcacccccagcagcccccagatgtgccgtttgggggtgctaaagctggtgttaagatctatcccaagaactataccgataacgaactggaaaagatcacaaggaggttcaccatggagctagcaaagaagggctttattgtctttgtatccagacaattctagcctcatggaatgagttgaggagtgttccttcctcttctgtttttggaaaagcttttgaaagtccacagatgtggggatctcaagaagcaggcgttcctggaactgtttcccgttcctgtgcttctggtattgaaaaccattcatcacctgcctgaattcttcagtggtcttcaaagaaaagtaaataaaatgttaagaagcaaga

SEQ ID NO: 350306 - DNA, 1750 bp, Homo sapiens
cgggacaacagatgacccggagaccgggggaggaccttcccatgcgcacgactcgcgatcttcccagtgccccagagccacggacccaaccgccgcctaccccagcccgcggcaccaaacctgttcacaactgcgactccttaggtccgcttggacaccgccggaaacggaaattcaccctcgcgccgacccgccggaggaaacaaaaaggcagaaaaaaagggaccgccgcctggacgacttgcaggggacagctggaagaaagactcgtcaacggccgagtgctggcgccggcgccgtctgcgcagtgcgttccaccgggtccgcgtccctcccgattcagccccaccccgccctcggaatccgctgcctcagctcctgctgtggcactccccagcagcttgcacctcgctcgcggagtccttgctgaaggccagggcagctgtgcggcctggcgcgggttacttgatgccgtgcaaaagccaggagacacatttggttctggccgccccggagtcaccgtgcccggggcgaatggactatggctggattgggagtccacttcctcctctgtaaagatgacagacgagggagatctcgcgttctgggggtgccctatagccctcttttggccagaagcggtggatcacgcctgtaatcccagccctttgggaggccgaggcaggaggattgcttgagcccaggagttcaagaccaatctgggcaacatagggaggctacatctctcaaaaaataaataaataaataaataaataaataaataaataaataaataaataaataaaaataaagccagcgtcgtggcggggcgcctgtggtccctgtggtcccagctactctggaggctgaggcgggacgatcgcttgagcctgggaggcagaagttgtagtgagctgagatcgagccactgcactccagcctgggcgacagagcaagacactgtctcaaagaaaaataaataaataaaataaggccctctttttccgggaccaacagactctgagggcagggacaaactgacccagcctaaactgcctcgccttccctgctcccgggaaaggggttttccctgagggaaggtagcatcttgccattttcttcctgcacagctttgccttcccagggatccacccattgccacctgaggaaatgccttggagcccatctaatccccagcccagctacttgggacgcctacagagactacattgtcagaggatgcatcttcctctagtcttggagggtttcttttcaatatgatcccaccggtgcatgcaaggctcaattctacatcaaaaaactaggcccactcctgtcaccgagacccccaggcttcaggtcctgtcacagtgaccttgttatcacccccagcagcccccagatgtgccgtttgggggtgctaaagctggtgttaagatctatcccaagaactataccgataacgaactggaaaagatcacaaggaggttcaccatggagctagcaaagaagggctttattgtctttgtatccagacaattctagcctcatggaatgagttgaggagtgttccttcctcttctgtttttggaaaagcttttgaaagtccacagatgtggggatctcaagaagcaggcgttcctggaactgtttcccgttcctgtgcttctggtattgaaaaccattcatcacctgcctgaattcttcagtggtcttcaaagaaaagtaaataaaatgttaagaagcaaga

SEQ ID NO: 350307 - DNA, 404 bp, Homo sapiens
gttaatctgctagtgagaatttaagtggactcctggggtggagtattctacaatggatggaacttggattctgaagtcagtcagttctggttcaaatcccagttattccatttactagctgtgtcatgttgggcaagctatgtaacctccctaaatcgttgtttcctcacctagaatatgaatacaatattaatagtactggtataacagttgttctgagaattaaataagatattgcatataaagaacttagttcagagtaaacacattataaaattcaacacatgttagtccccatgattacaattcttttggagcacaaaataatcagagatatgtaaaaaagatggttgtgaagagatgtttatgtaccatttttataagagtaaaaagttggaaacaat

SEQ ID NO: 350308 - DNA, 865 bp, Homo sapiens
ttcagttatgtgcccagccataattttacagagcaaactgcggattacagtccaacaggatcagaaccagaatgtgcccccagcttgccagcagtcagcactgcctttcattgtaccttttcctgcctttggaagaaaaatcactgaatttgcagcaggccgcagtatatgatctaggggtttcacttaagtagttaactccgtggaagagcagagattgtattgatgaagatttttatcaaggaataggtaacttatatctccctctctctagacgataatcaaagcaaaacttcctccttttttcctgaatttacatctcttaccccagagtctaagagtaatagttttccaaaaaatacttctttcctaaagaactcaaaattcttgtttcccttagtcccaaagtattgggatctgccccttaaccccattagtattaatgtgagtttcaagcaaacatccactgtccacattaggtgacatacatcactgtggtactgtcttgtactttctctaacgttctcaaaatgtcatcttcagtaagaaaatggccaaagccctctgccacctcaacgtccctgtcactgtggtgctagatgctgctgtcgggggtgagtgcccatcttccccagccataatcacctcccccaccccatgctggcttacagcaagttttcagattgaaagtttgagtcccgttcataaagccacaccaggtagcgtcctacttcttaattaatagctgccctaaaccagcaagcttgttatgaggttgtgatagcatacaaagaagacagagctgtaggatgttggggagagtgggagttgtgtctatagctttatggctgtaagtgttgagttt

SEQ ID NO: 350309 - DNA, 1823 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaag

SEQ ID NO: 350310 - DNA, 464 bp, Homo sapiens
tctagaggatcccgacacttgaaacgtaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttcaagtgtcgggatcctctaggacac

SEQ ID NO: 350311 - DNA, 2937 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctgggctcaagtgatcctcctgcctcagcctcccaaagtgctgggattataggcaggagccaccgcacccggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350312 - DNA, 1844 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagccaaaaaaaaaaaaaccaaac

SEQ ID NO: 350313 - DNA, 2178 bp, Homo sapiens
  misc_feature (13)..(14): n is a, c, g, or t
  misc_feature (18)..(18): n is a, c, g, or t
cttgtttgctggnntaanatgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctgggctcaagtgatcctcctgcctcagcctcccaaagtgctgggattataggcaggagccaccgcacccggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350314 - DNA, 1346 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttcaagtgtcgggatcctctaggacac

SEQ ID NO: 350315 - DNA, 2652 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcaggactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctgggctcaagtgatcctcctgcctcagcctcccaaagtgctgggattataggcaggagccaccgcacccggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350316 - DNA, 2055 bp, Homo sapiens
tctagaggatcccgacacttgaaacgtaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctgggctcaagtgatcctcctgcctcagcctcccaaagtgctgggattataggcaggagccaccgcacccggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350317 - DNA, 1747 bp, Homo sapiens
gcagataatagtaagtaaggactccaaatcatacattctagagagaaccctaactcactcagtactattccatctaggagtcgagtcgcctacacggagatcccctataatactgagctgcaagggttgcctagcaaggtatcgttcgcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctgggctcaagtgatcctcctgcctcagcctcccaaagtgctgggattataggcaggagccaccgcacccggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350318 - DNA, 1150 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaag

SEQ ID NO: 350319 - DNA, 1672 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaaggtaagagcatcagttctccccagttccctgctcaagacttggaggtgtcttgctgacctaggacaccacagcagtgttgattatggttccttctaatcctgcttcacttcaggacttcatcatggtattgagttgttgcccatttcccgtaagtcatagcaatgggcagtccagtttcagtcaaatcttttttagattgatctacataaatgaagacaatgtaatttggtcaggtgtgatgccttatacctgtaatcctagcaatttgagaggccagggtgggaggatcacttgaggccttgagttcaagaccagcctgggcaacatagtgaaaccctgtctctacaaaaaattagaaaaattagctgggcgtggtggtgcttgcctgtagttccagctgcccaggaagctgaggcaggagtatcacgtgagcccaggaatttgaggttgcagtaagttatgatcacactactgcattccagcctgggcgatggtgagaccctgtctcagtaaaaaaaaaaaaaaaaaaagtgtaatttatatttatacaaaattggcttgaattggaattgggattacaggcgtgagccaccacatccagcctctagtggctgtttctatatcctttgagaaacatttatttttttgattccaaagtcagaattagatatatctaatatatgtattagatatatgtatatctatattatatacataactttctattgctgttttttaattgttcctttattgtaattgagacgaggtctcaccgtgttgcctaggctggtcccaaactcatgggttcaggtgatccacccacctcggcctcccaaaatgctggaatacaggcatgcaccactgtg

SEQ ID NO: 350320 - DNA, 983 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcgggggtgagtgcccatcttccccagccataatcacctcccccaccccatgctggcttacagcaagttttcagattgaaagtttgagtcccgttcataaagccacaccaggtagcgtcctacttcttaattaatagctgccctaaaccagcaagcttgttatgaggttgtgatagcatacaaagaagacagagctgtaggatgttggggagagtgggagttgtgtctatagctttatggctgtaagtgttgagttt

SEQ ID NO: 350321 - DNA, 558 bp, Homo sapiens
tgtaccatcaggtctcctttctggttgtggttgatttgtgagaaagtgtacagagatgcttagggtgtcgggaacacgtgccgcagtgcagagggtgtgagtgagcagcaaggagcctgcccctttgacaaagctttctcggtccacagacaatattgactcacgcctactccagagtggtcctgagagtcctggaagcagccgtggcggccaagaagcgatttagtgtatacgtcacagagtcacagcctgatttgtcagggcaagtacctttctgttcagttatgtgcccagccataattttacagagcaaactgcggattacagtccaacaggatcagaaccagaatgtgcccccagcttgccagcagtcagcactgcctttcattgtaccttttcctgcctttggaagaaaaatcactgaatttgcagcaggccgcagtatatgatctaggggtttcacttaagtagttaactccgtggaagagcagagattgtattgatgaagatttttatcaaggaataggtaacttatatctccctctctctagacgataa

SEQ ID NO: 350322 - DNA, 464 bp, Homo sapiens
cgggcgtagtagctcacacctgtaatcccagcactttgggaggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350323 - DNA, 2920 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagctttttatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctgggctcaagtgatcctcctgcctcagcctcccaaagtgctgggattataggcaggagccaccgcacccggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350324 - DNA, 2819 bp, Homo sapiens
ttcagttatgtgcccagccataattttacagagcaaactgcggattacagtccaacaggatcagaaccagaatgtgcccccagcttgccagcagtcagcactgcctttcattgtaccttttcctgcctttggaagaaaaatcactgaatttgcagcaggccgcagtatatgatctaggggtttcacttaagtagttaactccgtggaagagcagagattgtattgatgaagatttttatcaaggaataggtaacttatatctccctctctctagacgataatcaaagcaaaacttcctccttttttcctgaatttacatctcttaccccagagtctaagagtaatagttttccaaaaaatacttctttcctaaagaactcaaaattcttgtttcccttagtcccaaagtattgggatctgccccttaaccccattagtattaatgtgagtttcaagcaaacatccactgtccacattaggtgacatacatcactgtggtactgtcttgtactttctctaacgttctcaaaatgtcatcttcagtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctgggctcaagtgatcctcctgcctcagcctcccaaagtgctgggattataggcaggagccaccgcacccggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350325 - DNA, 2416 bp, Homo sapiens
ggacattcttgcttcacttacacacatatgtacgtgtgcatgcgccgggcggcagtgtgaagtgtatgtctcattgtagggtcatgaccagaaaacacccctggtaacaatgccaggggtctatcgcgtgttaagtgcgctttaaaaaaaacaggtagttatgggaggaacttaccttgatagaaatggaatattgatctttgcagatgatgatgctactcgttagagccaagaaaataaagcatgaaaagctttttttccccctacatcatggagaaagcagatcttgtcatagttggtgctgaaggagttgttgaaacacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctgggctcaagtgatcctcctgcctcagcctcccaaagtgctgggattataggcaggagccaccgcacccggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350326 - DNA, 2058 bp, Homo sapiens
caggtcagagcactaaatattcagtgccgactaatgtgtacttctctcctcagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctgggctcaagtgatcctcctgcctcagcctcccaaagtgctgggattataggcaggagccaccgcacccggccaagactggaatgtttttagtaaaatattctgaagtgtgaaatccttcatttctccctcatctgaaaggacagctttcagagacatcattcttttcagatgtctcctgaagttgtgattttcgttaaaagcaaactggagccatccaccaagttagggaacagctatgtccttgtgggttcatctgtggcactggaatcagcagtcatcttccaaatctgagatccctaaatccactgtcttgattgttcttttgccagttgtcaacaagcccttctcaaattcttcttcagttattttgcctttcttaagttttttcaagagtcttgtgtcattaagaagttcttccatgtcctcatcttcaatatcagaaccgaagaatttgagaagtccagtaaccgggggcctctagagcgccgca

SEQ ID NO: 350327 - DNA, 1958 bp, Homo sapiens
atctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaaggtaagagcatcagttctccccagttccctgctcaagacttggaggtgtcttgctgacctaggacaccacagcagtgttgattatggttccttctaatcctgcttcacttcaggacttcatcatggtattgagttgttgcccatttcccgtaagtcatagcaatgggcagtccagtttcagtcaaatcttttttagattgatctacataaatgaagacaatgtaatttggtcaggtgtgatgccttatacctgtaatcctagcaatttgagaggccagggtgggaggatcacttgaggccttgagttcaagaccagcctgggcaacatagtgaaaccctgtctctacaaaaaattagaaaaattagctgggcgtggtggtgcttgcctgtagttccagctgcccaggaagctgaggcaggagtatcacgtgagcccaggaatttgaggttgcagtaagttatgatcacactactgcattccagcctgggcgatggtgagaccctgtctcagtaaaaaaaaaaaaaaaaaaagtgtaatttatatttatacaaaattggcttgaattggaattggggtttgtctggtttttgctttatttatgtgtatatgtatgttttatttatgcatatatatacacacacataatatatatacacaaatatttttaaaatattatttatatatttacatataaagtatgtatgtataaaatacgtgtatttatatataaatattatatatattttaaaatagagacacattcactctgttgcccaggctgtagtgtagtacagtgatcatagcttactgcagtcttgaactcctagcctgaagcaatctttccacttcccaaagtgctaggattacaggcatgagccactatccagcctctagtggctgtttctatatcctttgagaaacatttatttttttgattccaaagtcagaattagatatatctaatatatgtattagatatatgtatatctatattatatacataactttctattgctgttttttaattgttcctttattgtaattgagacgaggtctcaccgtgttgcctaggctggtcccaaactcatgggttcaggtgatccacccacctcggcctcccaaaatgctggaatacaggcatgcaccactgtg

SEQ ID NO: 350328 - DNA, 795 bp, Homo sapiens
cctcatggcctcttcctgttgagcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaagggtcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 350329 - DNA, 1464 bp, Homo sapiens
gaaggcgctgcgggcactccggatcgcattcacaaagtcgtcgtagtccgcaggagtcagtaaacaaatgaagagctagaggaagggtcctctgaagagccactggcacaactgcagtcaggtcaaatgatttacctgtaatccaggaaacgtgggaagaataagtacgtgagagccagttgggagaaacaaagttgtgcaggccaagggcataaagcccaatctcgaaggcgcaaaggtgcaggttgcggtgaggaccctggtggccccctgaggaagatggatgtgtgaaaatggaagtgctgctgttgccccctgccttgatcagcactgtcttcgccagctcgaagtagaagtgtgcagctgcctctgatggctgattggtcttcgcccgggctcctccactggcactggcccggcgacttccactggaggatgaggagcccagggagtccgaagaagagctgctaatgctgtcactgtcctgacctcgaccccaggaggtgggggcccagccccctcgaagtggtctccggcttaaggtgggggaactatccgatgttgtttcaggggcactgctgtcaatgctggccatgcctaacccccaagagaagtcagtctcagaagtcaggagtcccagatgttaagactccaaccttcaggattatccttccctctatgctagcccacaggctatcctacctgtgtgcttcttcttaggccgtcctggggacccccatccccgtccattatagcctccacgactgccaagtgccaagcggctaggaaccttcccttctggccttggggtcaaagctgcctcagatggaagaccctcacagggggaatgtggggaactctctaggtgaggaaaacaggacgctgggatgagcccaggaaaggggacctcaacataggtccacaccattcatcccccctgcccagtgcccccacctcaccaggcacattcttctctgtgaagccctcagtggggcctggcccagcccctgccacactccctggttgagcaggccctgcagagcctgaggtcagtggttgcagggcccctggggcagatgggcccccgtgctttgaaggagacctctggctggctgtggttgggcggctagatgagtagaaagaactcagcgtctgtggcttatgtgtctggctctctcggtccaagagtttgtctaagatctggaagacagaagcagtgacctccagagaagcagtgacaggatgccctttagctcctgacttctattaccttcctttctccttgaaacagccaattgctacatcctcagggagccttccccacttacaaccacaggatgacctcctggtttacatgtctttttgtaacttatttaaccccaacatatcttggtatcctccattaacaccacagggcagaatatactgatagtcaataaatactgaaataagtgaaaaaaaaaa

SEQ ID NO: 350330 - DNA, 3515 bp, Homo sapiens
attcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactggtgagcttatacccctactcctttggcatatcatagtttgacctgtcccttcactgtccacctccctgggcagacaagttgaagaaaagggtcaaggtttggggtcagactgctgtgaggagctagtggtgggcatgaatttaggttcgcatgggtggctggatggcaagttggcagtggggcaaatagaaagtcttaggcaaggatcagggatggaaggtggtcagtgttgttacaaaataaaggagggaacaggggctgactggctgtggtcagtggtcagcgtgtggtcatagggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaagggtcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 350331 - DNA, 3316 bp, Homo sapiens
attcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgaggtaagtaaagccaggggcaggggaatccctctccacttccaggatctgattctgtgtcccacttcttaccatttctgccttcattttctcctgtcagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaagggtcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 350332 - DNA, 3182 bp, Homo sapiens
attcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaagggtcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 350333 - DNA, 3775 bp, Homo sapiens
attcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactggtgagcttatacccctactcctttggcatatcatagtttgacctgtcccttcactgtccacctccctgggcagacaagttgaagaaaagggtcaaggtttggggtcagactgctgtgaggagctagtggtgggcatgaatttaggttcgcatgggtggctggatggcaagttggcagtggggcaaatagaaagtcttaggcaaggatcagggatggaaggtggtcagtgttgttacaaaataaaggagggaacaggggctgactggctgtggtcagtggtcagcgtgtggtcatagggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgagggactcccaatacaggcttgaatcaaactctaacatttagacagctttcaacatgcattgacctatgttctctatcaactgccagtccaagtatgggggtacataattgggggtagaaaggtgaaaaaattttaacaccctcagtaagagctttattgctataacttcagactcagtcctctataaatcccagtgtcctccatctacttctcattctatctttcaaatctcatctgttttttcttttccctccaggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaagggtcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 350334 - DNA, 448 bp, Homo sapiens
ctccaggtgctgccccggcagacatgtggcctcttcactcacacaatcttctataatgagtatcctggaggctctcgtgaactagaccggagcatccgaggtggagagctctttctgacagtgctgcttaatccggtaaggtgctgagaggaacggctagaagattggagagccaaggtgtttgcaggctgggacctttattcaccaaggctaattcagaggtggggtaggctctccaaatctgacatgcaggtaccccttacagatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcag

SEQ ID NO: 350335 - DNA, 3219 bp, Homo sapiens
attcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaagggtcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 350336 - DNA, 3279 bp, Homo sapiens
attcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtttgatgatgataagggattttggtgccagggacttgaaggtggtaagactcgctgtctaggccggagcaaaggccggaggtatccagatatggacactgaggtaagtaaagccaggggcaggggaatccctctccacttccaggatctgattctgtgtcccacttcttaccatttctgccttcattttctcctgtcagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaagggtcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 350337 - DNA, 3697 bp, Homo sapiens
attcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactggtgagcttatacccctactcctttggcatatcatagtttgacctgtcccttcactgtccacctccctgggcagacaagttgaagaaaagggtcaaggtttggggtcagactgctgtgaggagctagtggtgggcatgaatttaggttcgcatgggtggctggatggcaagttggcagtggggcaaatagaaagtcttaggcaaggatcagggatggaaggtggtcagtgttgttacaaaataaaggagggaacaggggctgactggctgtggtcagtggtcagcgtgtggtcatagggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggtgagacccttggatctcttccccataatttctcccagccatgcttccttttctaccttcccctaatgggctacccttttcctatcctttgcgtttttctttatttggaggcttccccaccctctttaccctctactccccaaacctcaccaggtcctggtgagagtctatgccattcccaggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaagggtcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 350338 - DNA, 3834 bp, Homo sapiens
attcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtttgatgatgataagggattttggtgccagggacttgaaggtggtaagactcgctgtctaggccggagcaaaggccggaggtatccagatatggacactgaggaaacgtgggaagaataagtacgtgagagccagttgggagaaacaaagttgtgcaggccaagggcataaagcccaatctcgaaggcgcaaaggtgcaggttgcggtgaggaccctggtggccccctgaggaagatggatgtgtgaaaatggaagtgctgctgttgccccctgccttgatcagcactgtcttcgccagctcgaagtagaagtgtgcagctgcctctgatggctgattggtcttcgcccgggctcctccactggcactggcccggcgacttccactggaggatgaggagcccagggagtccgaagaagagctgctaatgctgtcactgtcctgacctcgaccccaggaggtgggggcccagccccctcgaagtggtctccggcttaaggtgggggaactatccgatgttgtttcaggggcactgctgtcaatgctggccatgcctaacccccaagagaagtcagtctcagaagtcaggagtcccagatgttaagactccaaccttcaggattatccttccctctatgctagcccacaggctatcctacctgtgtgcttcttcttaggccgtcctggggacccccatccccgtccattatagcctccacgactgccaagtgccaagcggctaggaaccttcccttctggccttggggtcaaagctgcctcagatggaagaccctcacagggggaatgtggggaactctctaggtgaggaaaacaggacgctgggatgagcccaggaaaggggacctcaacataggtccacaccattcatcccccctgcccagtgcccccacctcaccaggcacattcttctctgtgaagccctcagtggggcctggcccagcccctgccacactccctggttgagcaggccctgcagagcctgaggtcagtggttgcagggcccctggggcagatgggcccccgtgctttgaaggagacctctggctggctgtggttgggcggctagatgagtagaaagaactcagcgtctgtggcttatgtgtctggctctctcggtccaagagtttgtctaagatctggaagacagaagcagtgacctccagagaagcagtgacaggatgccctttagctcctgacttctattaccttcctttctccttgaaacagccaattgctacatcctcagggagccttccccacttacaaccacaggatgacctcctggtttacatgtctttttgtaacttatttaaccccaacatatcttggtatcctccattaacaccacagggcagaatatactgatagtcaataaatactgaaataagtgaaaaaaaaaa

SEQ ID NO: 350339 - DNA, 2403 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatg

SEQ ID NO: 350340 - DNA, 1396 bp, Homo sapiens
  misc_feature (1)..(3): n is a, c, g, or t
nnnagaaaggaggagtggaagggaaatggcaggcagatgcagtcctgagctggtgcccccttgccttcgcagtcgtgcctagtaaacagctctctgaactttggtacatttgttctgactgatgtcactatcagctgatttcactttcgtttcctaacttgccagtggcccatgacttttcagaaatgagagcaactaagaggtctttcttggctctatgagaacctggtgggattcctgaagataaagtccacaaaaatgaagctccagacaagactatggccaccaggagtttctcactttcaagctagtgcgcactcagcctctggcaatttgttaaaatcactgtttaagtgttcctaccagtttatgattctagcagcttctgcctcagacaagcagatctcagcagtgactccctggattcgtctgtctcttcagatttcagggtagtagtttacttgtcagcctcagttctctgatggatccaataagttgctgatttttagtttgttcagcttttttgttgttgtaaggacaggaatgttgactttcaagcattattcatgttgcagctaaaacgagaaggccccttattatctgtttaaatagtaagtctatattttcttctaagagtagttttaactcctacatttgtttctgtgatccattttttattatttttagtgtatggtataaggaacacggccaacttcattcttttgcatgtggatatccagttgtcccagtaccatttgctgaaaagactattttttttccccatccaattgtcctggcatctttgttgaaaaatcaattgaaatatatataaaggtttatttacatattttcaatcctatttcatttatctatatgtttacccttaggccagtaccacacagtctcaattactatagcttggtagtcagttttgaaatcaggaatccttaaacattgttctttatcaaaattgctttggttattctgggtcccttgtatttccatataaatttcagatttggtttgttagtttctgcacaaaaggtagctgacattttgatagggattgcactgaatctatcaatttgaggagtattgccatctagcaatattaaatcttctgatccatgaccagagttatcttgccatttatttaaagcttctttaatacagttcaactgtgttttttgtagttttcagtttataagtcttgtacttcttttgtaaaatttattcctaagtattttgttctttttgatgctaatgtaaatggaattgttttcttaatttcattttttaaatgttcattgctagtgtatagagatacaattgatttttataacaggtttttgagatgtaattcacataccatacagttcattcattacaactgaaa

SEQ ID NO: 350341 - DNA, 2269 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagcaactaagaggtctttcttggctctatgagaacctggtgggattcctgaagataaagtccacaaaaatgaagctccagacaagactatggccaccaggagtttctcactttcaagctagtgcgcactcagcctctggcaatttgttaaaatcactgtttaagtgttcctaccagtttatgattctagcagcttctgcctcagacaagcagatctcagcagtgactccctggattcgtctgtctcttcagatttcagggtagtagtttacttgtcagcctcagttctctgatggatccaataagttgctgatttttagtttgttcagcttttttgttgttgtaaggacaggaatgttgactttcaagcattattcatgttgcagctaaaacgagaaggccccttattatctgtttaaatagtaagtctatattttcttctaagagtagttttaactcctacatttgtttctgtgatccattttttattatttttagtgtatggtataaggaacacggccaacttcattcttttgcatgtggatatccagttgtcccagtaccatttgctgaaaagactattttttttccccatccaattgtcctggcatctttgttgaaaaatcaattgaaatatatataaaggtttatttacatattttcaatcctatttcatttatctatatgtttacccttaggccagtaccacacagtctcaattactatagcttggtagtcagttttgaaatcaggaatccttaaacattgttctttatcaaaattgctttggttattctgggtcccttgtatttccatataaatttcagatttggtttgttagtttctgcacaaaaggtagctgacattttgatagggattgcactgaatctatcaatttgaggagtattgccatctagcaatattaaatcttctgatccatgaccagagttatcttgccatttatttaaagcttctttaatacagttcaactgtgttttttgtagttttcagtttataagtcttgtacttcttttgtaaaatttattcctaagtattttgttctttttgatgctaatgtaaatggaattgttttcttaatttcattttttaaatgttcattgctagtgtatagagatacaattgatttttataacaggtttttgagatgtaattcacataccatacagttcattcattacaactgaaa

SEQ ID NO: 350342 - DNA, 556 bp, Homo sapiens
ctctaaggtttcctgactgacagccttcccttgtgactgctgccgtctttccctaagtctggtcctgctttcaggttcctctcagtacagcctcagcccgaggttcccttcctcttgcatccatgtgtgtgtttcagaggcggccatccttccctacttccagatccttgtagggcagttggtggagggtgggaggcaccccggtgttgcctccatgaagccctgtgccagtcactgggctgcaaggctgaggaaattgtgtccgtgtcagaaagctcctcagctcagaggtgctggtacctcctgcgtggtaggaaggcagggggaagaggccctgcttctcctgttctctttgcccttatgagacttgagagtctgtgtcatctgtgccttgcatgtctttttttcagactccctgcgacaaggactgtgtactgcatgaatgaggctgagatagttgatgttgctctgggaatcctgattgaggtaaagtcagacaagcctcttactcatgaccagaaactctgcatgggcagaggctagacccttggtcacc

SEQ ID NO: 350343 - DNA, 3394 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350344 - DNA, 3517 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggtcggcgccgccagcggcgggtaccggcccgcagagggagggcgggctgtgaactggcagcacatcgcgttcccgcggggcccccattctgcccaggcagggagcggctgggatgggactgaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350345 - DNA, 3109 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacaagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350346 - DNA, 2959 bp, Homo sapiens
tttagcttaagggcggcgtgttggccaatgagactttattgtgaaataaaatgccctcagtttcatttaactgagccaccatagaagagtagagaaatcgagttggccagatgagggagaggccattaagaggtattttagggattgaatgggctgggcacccagaggacagtggcatttggggtggtaatgagaaggaacattaggggcctccgcctccttccgttcctcctgtgctgagtcagtcagcacagaggctgcaggaggtatctctggttggctttggctgcctgtagggggcaccagctttggggaggtcagagggctctctcctgagctgctgtcctgcccacaatcacacctgcctgatgcctgtgaatggccgtctgagtctcttgggccttggtcacttctggcctgccctgcaccgaccagtaactgtgcctgatgactggaggtatgggaattcaccggactttattgttctttgtaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350347 - DNA, 2598 bp, Homo sapiens
tttagcttaagggcggcgtgttggccaatgagactttattgtgaaataaaatgccctcagtttcatttaactgagccaccatagaagagtagagaaatcgagttggccagatgagggagaggccattaagaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350348 - DNA, 2921 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacagactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350349 - DNA, 1664 bp, Homo sapiens
gcgatctggctgcgacatctgtcacccattgatcgccagggttgattcggctgatctggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacaagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350350 - DNA, 2522 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagcaactaagaggtctttcttggctctatgagaacctggtgggattcctgaagataaagtccacaaaaatgaagctccagacaagactatggccaccaggagtttctcactttcaagctagtgcgcactcagcctctggcaatttgttaaaatcactgtttaagtgttcctaccagtttatgattctagcagcttctgcctcagacaagcagatctcagcagtgactccctggattcgtctgtctcttcagatttcagggtagtagtttacttgtcagcctcagttctctgatggatccaataagttgctgatttttagtttgttcagcttttttgttgttgtaaggacaggaatgttgactttcaagcattattcatgttgcagctaaaacgagaaggccccttattatctgtttaaatagtaagtctatattttcttctaagagtagttttaactcctacatttgtttctgtgatccattttttattatttttagtgtatggtataaggaacacggccaacttcattcttttgcatgtggatatccagttgtcccagtaccatttgctgaaaagactattttttttccccatccaattgtcctggcatctttgttgaaaaatcaattgaaatatatataaaggtttatttacatattttcaatcctatttcatttatctatatgtttacccttaggccagtaccacacagtctcaattactatagcttggtagtcagttttgaaatcaggaatccttaaacattgttctttatcaaaattgctttggttattctgggtcccttgtatttccatataaatttcagatttggtttgttagtttctgcacaaaaggtagctgacattttgatagggattgcactgaatctatcaatttgaggagtattgccatctagcaatattaaatcttctgatccatgaccagagttatcttgccatttatttaaagcttctttaatacagttcaactgtgttttttgtagttttcagtttataagtcttgtacttcttttgtaaaatttattcctaagtattttgttctttttgatgctaatgtaaatggaattgttttcttaatttcattttttaaatgttcattgctagtgtatagagatacaattgatttttataacaggtttttgagatgtaattcacataccatacagttcattcattacaactgaaa

SEQ ID NO: 350351 - DNA, 1763 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggtcggcgccgccagcggcgggtaccggcccgcagagggagggcgggctgtgaactggcagcacatcgcgttcccgcggggcccccattctgcccaggcagggagcggctgggatgggactgaggtcggtccgcgagcgcggtgccccagagacccggcttctggaagttgccgcggcctgctcttggggcccagaagtagggcggggaggcgcggggtctggagtctgcaggacctggctgcgaatccaaccagctgatttcaaacttttctgtgatcttctgcaagttaactaagtctcagttcctcgtttgcgaaatgtacttaataggcaccccagggtgaactaaatttgtccgcacagactgcagcattgcgcttgggaggcgccttagggggtaggagtcactaatatcactgagttttgacagaaatgaaggtgcattggcaaaggtgtgccccatggccgggcaggttaggaggagggcctggtaatattttttcttaaattgtaaacagccatctggatgagcaatacattatcaaattatgattcagagaggactatcgctgactactcttttttttgggcaaacctccgcttcaggagcttctggcttgattcctaagtggaaggtagagacctaggccctctgagtcacaactccatctctctgggtgaggactgagctccaggactgctgagtggaggcagaacaattgggatagggaaaagagaggccaaactagatcagaggctggcgtgggcttcagaatctacagactggcacagttaatgcctccgggcccctattgctgcttcaagtttgaccaat

SEQ ID NO: 350352 - DNA, 1597 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctggcaagtggagcaggggcctccatgacctgggccaggtcttccagcctaggcagaacagcaagatgggcgggtgtttcagtctgatcatctcttgagcttttagaaggtggaggggctgtgggcgggaggcaaagcgggttaaccctcgaggacaggcacccacttctgcctctgcactggtgagtgccctgccctcagcacacacagagtgggttctccatgtcagccagtctctgatgccagttgtccagaatgccagtctcttcctttacaacaaacatggtaacatcagatgggcaagatcagtggaagggtctgttctgagtggtgcctgcccctgtggacagacctttaggg

SEQ ID NO: 350353 - DNA, 1022 bp, Homo sapiens
  misc_feature (1014)..(1014): n is a, c, g, or t
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggtgaggcgtgggtcccacaaccgcttggaatttgcctcccggctccgctctggaagctaagaaggggcacgagagccggagacgggaacctgagagcagggaagccagtagccggccggaggagcgcgcggccgctccagtcggaaggagccgttgcagccctgcccggcgtgtggcggggtcagcgaggcccctgcggtgcttcgcccgcgccttccgctccgcactcacccgccctctgggcctcccacaggaatcaaagatcaactcccactgaggacaaatggacctgtaattccgggtgtgacgagagaacgagatttacaggtccatttgtcntcagtggg

SEQ ID NO: 350354 - DNA, 1162 bp, Homo sapiens
tttagcttaagggcggcgtgttggccaatgagactttattgtgaaataaaatgccctcagtttcatttaactgagccaccatagaagagtagagaaatcgagttggccagatgagggagaggccattaagaggtattttagggattgaatgggctgggcacccagaggacagtggcatttggggtggtaatgagaaggaacattaggggcctccgcctccttccgttcctcctgtgctgagtcagtcagcacagaggctgcaggaggtatctctggttggctttggctgcctgtagggggcaccagctttggggaggtcagagggctctctcctgagctgctgtcctgcccacaatcacacctgcctgatgcctgtgaatggccgtctgagtctcttgggccttggtcacttctggcctgccctgcaccgaccagtaactgtgcctgatgactggaggtatgggaattcaccggactttattgttctttgtaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctggcaagtggagcaggggcctccatgacctgggccaggtcttccagcctaggcagaacagcaagatgggcgggtgtttcagtctgatcatctcttgagcttttagaaggtggaggggctgtgggcgggaggcaaagcgggttaaccctcgaggacaggcacccacttctgcctctgcactggtgagtgccctgccctcagcacacacagagtgggttctccatgtcagccagtctctgatgccagttgtccagaatgccagtctcttcctttacaacaaacatggtaacatcagatgggcaagatcagtggaagggtctgttctgagtggtgcctgcccctgtggacagacctttaggg

SEQ ID NO: 350355 - DNA, 2113 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaagactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatg

SEQ ID NO: 350356 - DNA, 3141 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350357 - DNA, 3242 bp, Homo sapiens
  misc_feature (1073)..(1073): n is a, c, g, or t
  misc_feature (1079)..(1080): n is a, c, g, or t
  misc_feature (1082)..(1082): n is a, c, g, or t
  misc_feature (1084)..(1084): n is a, c, g, or t
  misc_feature (1090)..(1090): n is a, c, g, or t
acgagccggcctggtgcgcgcgactgactggtcgaacggctaggcgagtgcgggcgaggcgagctcgcgagccgacggcgacggtggcggcggcctcgaccttgacgcgggacatcacgacgggccggccgtggttcgactgatgggtcgcggcgcgtgagtgcgggacggcgcggtgaagtagggagtgaggcggctggagcgacgtgttggcgcgcgaggcactgtaggtggttgagtgtgaggggaaggaggggtgaggggggggaggaggggtggtgagtgcatgtgtgttggtagaggtgtaatctatgtggagtggtaaataagtgtttgaagcgggatcgtgtgacgcaccactgatcgcgacagggatcaggcactggccagagatgcatatggtgtgagccttgatcactggagcaccatcgatcatacgataggatggttagtgctcaggcgtcggcgggcgaagtgtcagcgcatgcgagcagagctagcagccgcttctttttgccagtcgcggctccccccttgtgtattaaaagagtgtgtcgacatagtctgtgttctcggctggggcgcggggtgctttctttgaggaggcgcgggggggcggatcgtcgcgtgggtttggttgtgacgccccggttatggcgcgcggttggaaacactgtggttagtgttgtaccccctcgggtggcggccggcttgagggtttcgcctgtgcgtgggggggttgggtgttgcgccccagttttttgttcgtccgccccccccctcgctggtgtcgtttgggggtgcgttcgtttctccgcagtgtggtgctactggtgtgcgcgagtgtttttctccacgtcgctggctcgtttggtgtttttagaccgcccgcggcgcctctgtcgcttggctgttatttataacagcggctgctcagctattttggggcgcccccctttgttcacacaagagctactggggtgcgtcgcgattacttttggggccccccggggggaaattaggaggcgccgccccccctttttttttttttgttttttttttttttttttttntttttnntntntttttnttttttactgacagatcagcatgttagggaaataaaacacgtatgttgagcctgcgttttcccgtactccacagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggtccagggaagctttgaagcagtcaagccttgtctttgtaccccatgtgtcctgtctttgttgagtcactcagagatcactcctggacctctggggttggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350358 - DNA, 3042 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatgcgtaagttgtgctaatgtctttccaagttctgggttgggaagtggagggtggcagcgtttgtttgtgcgcaaccgtccagtcctgttcacagcgaggatttggagtcctccagggtctcatcatgggagtgatttgtcagcggacgcctctgccctgtctggcttcaggagttccagtgatggcttatggcggcccactcactatggtgggctgagtggaagctccttaaccatgtccccagagacactgaggtgctcgctcttttaatgtcctcgtttgttgccgtaagttctttgctaggtttcattttggcatttggcaaatcagcctggaagtctggccccatgacagcaatcactccctccccaccctcctgaagctagaggaagatttgctcagatccattaattaaagcaggaattggtgtgacaatgagctgcatggtttagggagtctttgggagccttggaagtcctgaaggacagacaatcttgtactaagaagtcacaggtgccctggctgcccttgctgcccctcggcctctttgacacaggggccccacctcctctgtagtgggttccatcgctggagctggagatcagcgttagctgtaaaatgagatggctgagcagatgtgccacctctgaccatggttggaactgaacccttgcaatcacgtaagcctttagcagctctcaagcttgctctcagccctctcagccctcagagggaacacagccatggctataagcaagaggatgagtaaggcctgggcgctgccagagctagaaacccaggccccgggagggagagctgacccacttcacacataggagaggaagaggcccaggccgcctgccagcagcacagaggacacagccaggaagccca

SEQ ID NO: 350359 - DNA, 2007 bp, Homo sapiens
aaaaaaaaaaaaaaaaacaggtactgagtataaaacaatatgagagggtctctctcttccctcgctttaactttcggagggctgaaattctttctagccttggttaatacagcaattcattccattctagctattgttatttctcttactataattttactattagtacttacgctattctattattttcttaattttccacttaattaggataacaaaccgaggccgggctcccatcctcctcaagcacacgaggggggcctggcccagcagggagcttcgcctggtttctgagggaattcccggcgggcctttccaaaacatgcccgttcccttccgctaacttcaggggcggagaattgaactttcaccctcctcaagccggtggcgctgcctcgctggcgttcccagcgcgcagccaaccggatgccagccggcggcattagcactgccagcatggggcgcccgcggacctccgactgaggcagctgccgggagccggaagtgtcccgggcgccgggactgcgagggggccgggagttccccaagaccggaagtgtcccgaggccgggagcccgcgggaccccggagcgcgcggggccggaagaggcgggcggccagtggaggtccgcagagtttgggcgccaggcgagacggcagggcttaaagttccgggaatcaaagatcaactcccactgaggacaaatggacctgtaattccgggtgtgacgagagaacgagatttaccttcctgaattaaaaaacaggtcattaagcttgggccctgactcttctttgtgagaaggtacagagatggaaaccttacaatccgagactaaaacgagggtccttccctcatggctgacagcccaggtggctacaaagaatgtggcaccaatgaaggcccccaagaggatgagaatggcagcagtgccagtggcagcagcaaggtgcgacagctctggtcagaagactcctgcgaatctgactccctgcgacaaggactgtgtactgcatgaatgaggctgagatagttgatgttgctctgggaatcctgattgagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagctataaagcaagagggacaggagcccagaagagacactgaggacaagagatcacaccagagtacatgtctctgcctctgttttcagtgtggctttggacaggaatatatgaataaatcactgccatacaggttttccaatacacaagtgctagaaaatacacacaattccccaatg

SEQ ID NO: 350360 - DNA, 804 bp, Homo sapiens
tgtttgtgtgctttttgagtcatgcaaatgtagcgcctatttaaaaaccagaatttctaaaactcagaacctctgctgctcagtagctccctggcctttatttgacagtttttatcacttctcttggcaatgattttgttgttaagccaacaacattctcaaattcatgacacactatcaaatgccaccctcagtccaaatgacatttattccattttctctgtgggacatccagctaaagaggaaaaagaacgtattttcaaattattctgtctcttagccatagttacctagggaaggagtgaaagccattgagagtccacagacagaactcgcagccctggctcccctgcccctgtaggaggcggggaaggagtgagcttcaggccaggagggtccacggccccctgcagccatcctgcagcttccagtcctcctcctggaccatccctgcactcagaccttctccccggcccaccttccttcctcctctgggatcagacttcggtactgtgtcctcagggaccttcctctgtggccggcacccagtgatccctggctcctcagcacacccagctcagaggtcggcagcccctgcccacgagctccagccggccctgcatggccttatgctggaaccagcctcctgagtagttgggattacagcagtgcaccaccacgcccaactaattttttgcatttttagtagagatggggtttcactatgttagccaggctggtctcgaactcctggcctcaagtgattggcccaccttggcctcccaaagtgctgggattataggc

SEQ ID NO: 350361 - DNA, 617 bp, Homo sapiens
tgaaacaaggggcaaggatgggtttgtgtcaccaaaaacaggttccttgttgttatttaaggagttactttttttttctatatttgcatacttagaggacctgtccatataaaaatttttgagtttttcaaagaccacactatttttaataacatcagtaaaattcagtcaaaattgtcccatcactctaagacctgcccagcaggaaaggctctgacgtgtccaggctggccctggcacagtgagaagctcaagctatcctccttagctctagttcagcacccaggaaaacatctcagggtactccctgggtggaacgtggaggcctggagctcccctcacacctccgcctcccccgtcctgccctcccgcgtggtccaggcgcttctcgtccctgaagacgttcctctggttcctgctgccgctgctcttgctgacgtgcctgacgtatgcgagtaccatcctgggccagggagaggctgacctttaaagctgctctgagcatctcggttagggttaaaggctaggcctggggcatctgccgtccaccttcagcgaggagacagccaatggcctgagcggggccctcctcccgtgcgggagcccaccctgccttc

SEQ ID NO: 350362 - DNA, 353 bp, Homo sapiens
ctgcttgtttttcagaggaggactttctagctggactaaccagaccttcgggtttctgcagcctgggttgggaagtggacttctatactcaccacacaacccagagaactggtcatttaagtatcaaccaggaatattagaagtgatcaaaagtcacaagcaagtgctaggaattcccaagtgactttgttgtacgggccagcagaggcactaacgttgagactccccatgttggcagtcggggactttgaattcgggtgtctagacctgagtggttcattaatcttcctcatgtcacagaatgctacctcttgccagatctttgcactttggcttcctttgtcctcattatc

SEQ ID NO: 350363 - DNA, 3974 bp, Homo sapiens
ggttttgtgccagacaggccgtttccagggacaggcagttcccagcctctgcctgtcagaactcagggcctcagaggaaggcccgttttgttcagttctaaaacaaaacaaaacaaagcaatggggggcgcggtgtgacttagagagccaggaggcgcgcctttggtgacaatttctgcaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350364 - DNA, 3836 bp, Homo sapiens
ggttttgtgccagacaggccgtttccagggacaggcagttcccagcctctgcctgtcagaactcagggcctcagaggaaggcccgttttgttcagttctaaaacaaaacaaaacaaagcaatggggggcgcggtgtgacttagagagccaggaggcgcgcctttggtgacaatttctgcaggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350365 - DNA, 3458 bp, Homo sapiens
tgaaacaaggggcaaggatgggtttgtgtcaccaaaaacaggttccttgttgttatttaaggagttactttttttttctatatttgcatacttagaggacctgtccatataaaaatttttgagtttttcaaagaccacactatttttaataacatcagtaaaattcagtcaaaattgtcccatcactctaagacctgcccagcaggaaaggctctgacgtgtccaggctggccctggcacagtgagaagctcaagctatcctccttagctctagttcagcacccaggaaaacatctcagggtactccctgggtggaacgtggaggcctggagctcccctcacacctccgcctcccccgtcctgccctcccgcgtggtccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350366 - DNA, 4202 bp, Homo sapiens
tgtttgtgtgctttttgagtcatgcaaatgtagcgcctatttaaaaaccagaatttctaaaactcagaacctctgctgctcagtagctccctggcctttatttgacagtttttatcacttctcttggcaatgattttgttgttaagccaacaacattctcaaattcatgacacactatcaaatgccaccctcagtccaaatgacatttattccattttctctgtgggacatccagctaaagaggaaaaagaacgtattttcaaattattctgtctcttagccatagttacctagggaaggagtgaaagccattgagagtccacagacagaactcgcagccctggctcccctgcccctgtaggaggcggggaaggagtgagcttcaggccaggagggtccacggccccctgcagccatcctgcagcttccagtcctcctcctggaccatccctgcactcagaccttctccccggcccaccttccttcctcctctgggatcagacttcggtactgtgtcctcagggaccttcctctgtggccggcacccagtgatccctggctcctcagcacacccagctcagaggtcggcagcccctgcccacgagctccagccggccctgcatggccttatgctggaacgtctctggaatcttttccctttctttctgtgttggctgtgtcggggtggtctttgggaagcactatcatccaagggtccctcactccgtggctctctctctgcccttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaaggtactgggcgccaccagctggcctcggcctgctcctccccagccccacccactctccaggcaggactggggagcagagccgcagagcagagagttctgatcatcttgccaagcagatggtagggggaggggttgaaacccagctcaggacccctgcccagggcctgtctttgaggtgccatggaggttagcaggggggtcctgagggcggggggcaggctgtgtgagaggaccgggattcatttatagacacagcatcctttcttacagcctcacataactgccttctcatgccccagatgtccatgcttgtggaggatgtgagaggctgaggcagagtacattctggactctgggcttagaaagggagcaggctcagaattagctccttgggacaggcaggggttctgcagccagaacccccaggagaggccttgccccttctcaggttcacaatgagtgctgggcacccgctctcctgacgggagcccactagggggtcctctttcatctttggtgtggccttacctcccaccaaagagatccgaggcttactcttctctctctgggaccagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350367 - DNA, 3772 bp, Homo sapiens
tgtttgtgtgctttttgagtcatgcaaatgtagcgcctatttaaaaaccagaatttctaaaactcagaacctctgctgctcagtagctccctggcctttatttgacagtttttatcacttctcttggcaatgattttgttgttaagccaacaacattctcaaattcatgacacactatcaaatgccaccctcagtccaaatgacatttattccattttctctgtgggacatccagctaaagaggaaaaagaacgtattttcaaattattctgtctcttagccatagttacctagggaaggagtgaaagccattgagagtccacagacagaactcgcagccctggctcccctgcccctgtaggaggcggggaaggagtgagcttcaggccaggagggtccacggccccctgcagccatcctgcagcttccagtcctcctcctggaccatccctgcactcagaccttctccccggcccaccttccttcctcctctgggatcagacttcggtactgtgtcctcagggaccttcctctgtggccggcacccagtgatccctggctcctcagcacacccagctcagaggtcggcagcccctgcccacgagctccagccggccctgcatggccttatgctggaacgtctctggaatcttttccctttctttctgtgttggctgtgtcggggtggtctttgggaagcactatcatccaagggtccctcactccgtggctctctctctgcccttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctgaaaaaaaaaaaaaaatgaacataatcagaaaaaaaaaggggggggggaaaaaatatcccggggggccattgggcacctttttgaaaggggcccaggggggggaataaaaagaggggggggggtgaagggggggggagaaacggg

SEQ ID NO: 350368 - DNA, 2280 bp, Homo sapiens
ggccccactcgcgcagcgcgggcctccgccggccgcattgtccgcccgcccgcgcttgtcccgcgtcgccgctcttcgcgtgcccgctgcgccccgggcccggccgctgtgtcgccctgagcggagcgccgcccgcgggatccccacgcggaaagggggcgcgccccggcggcggcctggcctcggacgcccccggccgggctagaagccgccgcggcagcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350369 - DNA, 2587 bp, Homo sapiens
tgtttgtgtgctttttgagtcatgcaaatgtagcgcctatttaaaaaccagaatttctaaaactcagaacctctgctgctcagtagctccctggcctttatttgacagtttttatcacttctcttggcaatgattttgttgttaagccaacaacattctcaaattcatgacacactatcaaatgccaccctcagtccaaatgacatttattccattttctctgtgggacatccagctaaagaggaaaaagaacgtattttcaaattattctgtctcttagccatagttacctagggaaggagtgaaagccattgagagtccacagacagaactcgcagccctggctcccctgcccctgtaggaggcggggaaggagtgagcttcaggccaggagggtccacggccccctgcagccatcctgcagcttccagtcctcctcctggaccatccctgcactcagaccttctccccggcccaccttccttcctcctctgggatcagacttcggtactgtgtcctcagggaccttcctctgtggccggcacccagtgatccctggctcctcagcacacccagctcagaggtcggcagcccctgcccacgagctccagccggccctgcatggccttatgctggaacgtctctggaatcttttccctttctttctgtgttggctgtgtcggggtggtctttgggaagcactatcatccaagggtccctcactccgtggctctctctctgcccttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350370 - DNA, 1687 bp, Homo sapiens
tgtttgtgtgctttttgagtcatgcaaatgtagcgcctatttaaaaaccagaatttctaaaactcagaacctctgctgctcagtagctccctggcctttatttgacagtttttatcacttctcttggcaatgattttgttgttaagccaacaacattctcaaattcatgacacactatcaaatgccaccctcagtccaaatgacatttattccattttctctgtgggacatccagctaaagaggaaaaagaacgtattttcaaattattctgtctcttagccatagttacctagggaaggagtgaaagccattgagagtccacagacagaactcgcagccctggctcccctgcccctgtaggaggcggggaaggagtgagcttcaggccaggagggtccacggccccctgcagccatcctgcagcttccagtcctcctcctggaccatccctgcactcagaccttctccccggcccaccttccttcctcctctgggatcagacttcggtactgtgtcctcagggaccttcctctgtggccggcacccagtgatccctggctcctcagcacacccagctcagaggtcggcagcccctgcccacgagctccagccggccctgcatggccttatgctggaacgtctctggaatcttttccctttctttctgtgttggctgtgtcggggtggtctttgggaagcactatcatccaagggtccctcactccgtggctctctctctgcccttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggaggtgaggcccacatgcccctctccacacacccacccacagctctcctccctgggagccctggacagtcccacactgccagctccctggcaggttccaggatggaagtgccaagcaggaggctttgcatgctgtggggctggcatgggtgggtggcagtgtgcccacatctgcc

SEQ ID NO: 350371 - DNA, 258 bp, Homo sapiens
ctggtgggcagcgaaggacagcaggaggccggatgagggctgggaagccagagactcatcgccacatttccaggtgagtctctgagggtggtagctcccaagagcttagcaataattaggtgacggtgaaagtggtgggtgcgccctcagcctgcctcacaccgtacacacaaagctgaggcgtactgttagttgccatcttacaaggcacagaaaacagaaagaaaaggaatccaacaaattatcttgtctgctttg

SEQ ID NO: 350372 - DNA, 156 bp, Homo sapiens
ctcctgctgtccctgcaagccccccagggtgacacccctttgggttcctataggtggaatctcagttcccggcctggatcagtcagttccttgcccgaggtggagggggccgcgtggggctccttcagagagaggagatgcaagctcagctgcgag

SEQ ID NO: 350373 - DNA, 422 bp, Homo sapiens
aaacactgctcaggaggctaaagataggagcttttgaagcctggttctcttcagagccccagggaaggagcaggggagccatctggccctaggcgaggctgtctccccttcccaccttctctgtcagtgaggcctcacaggtctctgatgctcttaatccctttcttctctacccaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatg

SEQ ID NO: 350374 - DNA, 728 bp, Homo sapiens
tggtttaagtctgaagatggatggagatgtttgtgatggggaagggcggaattgagaaaggaagtcgcccagctgagaagtggggaaggatgctttccgatgagcgtttcctaactgattgttagggaggaggtggggcgggggtggtgtctattatgattcgcagtagtagatttcagctcccagaggctcacttcttgttttggagaatggggcctcgacctttttcatcttgtgaaacccagactcaatggtaaactgttttgtgatgccaggatgccgcaggaaagactgagaggcatctctgggagttctgggagggcggaggcgggtgctgacagttttcagcactccccgctcaacctccatcagaatatttagttcttcccagcggcagcttgggtatggtataaacatgttgccttgtttctgccctgggcaaaggtgtcacctccttcagcaggacagaggctaagaggagtccctgtgtgggcagctggagccttcaggtagggaccgtacgggcggggcagggaggggggaggggagattaccttataaggacaggaatagagacaaggacccaggccaacttcctgcttttcctactaccaatcggtcccttttccaacaccagctaaaagtagaggggatgccagatgggcgtctgacctgggaagatgccaacaaggccaggacatgaggctgcttgtttttcagaggaggac

SEQ ID NO: 350375 - DNA, 3628 bp, Homo sapiens
tgtttgtgtgctttttgagtcatgcaaatgtagcgcctatttaaaaaccagaatttctaaaactcagaacctctgctgctcagtagctccctggcctttatttgacagtttttatcacttctcttggcaatgattttgttgttaagccaacaacattctcaaattcatgacacactatcaaatgccaccctcagtccaaatgacatttattccattttctctgtgggacatccagctaaagaggaaaaagaacgtattttcaaattattctgtctcttagccatagttacctagggaaggagtgaaagccattgagagtccacagacagaactcgcagccctggctcccctgcccctgtaggaggcggggaaggagtgagcttcaggccaggagggtccacggccccctgcagccatcctgcagcttccagtcctcctcctggaccatccctgcactcagaccttctccccggcccaccttccttcctcctctgggatcagacttcggtactgtgtcctcagggaccttcctctgtggccggcacccagtgatccctggctcctcagcacacccagctcagaggtcggcagcccctgcccacgagctccagccggccctgcatggccttatgctggaacgtctctggaatcttttccctttctttctgtgttggctgtgtcggggtggtctttgggaagcactatcatccaagggtccctcactccgtggctctctctctgcccttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350376 - DNA, 3892 bp, Homo sapiens
gaatggggcctcgacctttttcatcttgtgaaacccagactcaatggtgtcacctccttcagcaggacagaggctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgagtgtggagccctccgtcccggggctttgcttcctcggcctcccgcgagatactcctcacagtgtcccctgcagtccccgggattccctcctcagagcacctctctgcccagaccccacttttcagaagctcttggaggcccagaagagcccctggttcttccctgcacaggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350377 - DNA, 3830 bp, Homo sapiens
ggccccactcgcgcagcgcgggcctccgccggccgcattgtccgcccgcccgcgcttgtcccgcgtcgccgctcttcgcgtgcccgctgcgccccgggcccggccgctgtgtcgccctgagcggagcgccgcccgcgggatccccacgcggaaagggggcgcgccccggcggcggcctggcctcggacgcccccggccgggctagaagccgccgcggcagcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350378 - DNA, 2995 bp, Homo sapiens
ggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaagggcggccgtcgcgatctagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350379 - DNA, 3650 bp, Homo sapiens
tgtttgtgtgctttttgagtcatgcaaatgtagcgcctatttaaaaaccagaatttctaaaactcagaacctctgctgctcagtagctccctggcctttatttgacagtttttatcacttctcttggcaatgattttgttgttaagccaacaacattctcaaattcatgacacactatcaaatgccaccctcagtccaaatgacatttattccattttctctgtgggacatccagctaaagaggaaaaagaacgtattttcaaattattctgtctcttagccatagttacctagggaaggagtgaaagccattgagagtccacagacagaactcgcagccctggctcccctgcccctgtaggaggcggggaaggagtgagcttcaggccaggagggtccacggccccctgcagccatcctgcagcttccagtcctcctcctggaccatccctgcactcagaccttctccccggcccaccttccttcctcctctgggatcagacttcggtactgtgtcctcagggaccttcctctgtggccggcacccagtgatccctggctcctcagcacacccagctcagaggtcggcagcccctgcccacgagctccagccggccctgcatggccttatgctggaacgtctctggaatcttttccctttctttctgtgttggctgtgtcggggtggtctttgggaagcactatcatccaagggtccctcactccgtggctctctctctgcccttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctgtgggatgtggctttcatgtggc

SEQ ID NO: 350380 - DNA, 2847 bp, Homo sapiens
tgtttgtgtgctttttgagtcatgcaaatgtagcgcctatttaaaaaccagaatttctaaaactcagaacctctgctgctcagtagctccctggcctttatttgacagtttttatcacttctcttggcaatgattttgttgttaagccaacaacattctcaaattcatgacacactatcaaatgccaccctcagtccaaatgacatttattccattttctctgtgggacatccagctaaagaggaaaaagaacgtattttcaaattattctgtctcttagccatagttacctagggaaggagtgaaagccattgagagtccacagacagaactcgcagccctggctcccctgcccctgtaggaggcggggaaggagtgagcttcaggccaggagggtccacggccccctgcagccatcctgcagcttccagtcctcctcctggaccatccctgcactcagaccttctccccggcccaccttccttcctcctctgggatcagacttcggtactgtgtcctcagggaccttcctctgtggccggcacccagtgatccctggctcctcagcacacccagctcagaggtcggcagcccctgcccacgagctccagccggccctgcatggccttatgctggaacgtctctggaatcttttccctttctttctgtgttggctgtgtcggggtggtctttgggaagcactatcatccaagggtccctcactccgtggctctctctctgcccttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacaaggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggccttccaggggccacaaggcttcgccgtggtccgcctctctgcccgcatccgccccgcagccgttaccttagagcatgtgctccaaagccttgtcacccaacagcactgggtgatactcagtttcttgttcctggccgtggagaggggcctggggcactggttccggctgtgtctggtggtctggctgcggggaaggggcaagaaggcgggcaggccttcactgcagcactgagcctcaaatccgctctggagcatgaggctggatgcagtggtggtgaggccgccccgctccatcccgaggcagccagggtttgttttgcgctctcctgtcacaaatgctgcactattggttcttaagttttttatctccagatcctaatttatgcctatgcaaaaaataaatgacgcccaagagctg

SEQ ID NO: 350381 - DNA, 1146 bp, Homo sapiens
ggccccactcgcgcagcgcgggcctccgccggccgcattgtccgcccgcccgcgcttgtcccgcgtcgccgctcttcgcgtgcccgctgcgccccgggcccggccgctgtgtcgccctgagcggagcgccgcccgcgggatccccacgcggaaagggggcgcgccccggcggcggcctggcctcggacgcccccggccgggctagaagccgccgcggcagcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggcagggtttcaagagagaaccaaggcaaccagacctttgaggccttgatccagaaccagcacaccgtcactcc

SEQ ID NO: 350382 - DNA, 523 bp, Homo sapiens
cccagggaaagctacaagcagcaaacagtccgcatgggtcatccccttcactcccagctcagagcccaggccaggggcccccaagaaaggctctggtggagaacctctgcatgaaggctgtcaaccagtccataggcaagcctggctgcctccagctgggtggacagacgggctggagaaggggagaagaggaaagggggttgcctgccctgtctcctacctgaggctgaggaaggagaaggggatgcactgttggggaggcagctgtaactcaaagccttagcctctgttcccacgaaggcagggccatcaggcaccaaagggattctgccagcatagtgctcctggaccagtgatacacccggcaccctgtcctggacaagctgttggcctggatctgagccctcgtggaggtcaaagccacctttggttctgccattgctgctgtgtggaagttcactcctgccttttcctttccctagagcctccaccaccccgagatcacatttctcactgccttttg

SEQ ID NO: 350383 - DNA, 517 bp, Homo sapiens
ggtagagacagggtcttgctacattgcccaggctagtcttgagctcctgacctcaagcgatcctcctgcttcggcctctcaaagtgttgggattataggcgtgagccaccgcgcctggctagcaatttttaaatatgaattgctgcatgatctgctcttctttgttagaacagacttacaagaacactcattcaaatatagatctgactgaatatgttaaaaagtagaatagttggctggaggctgaggtgggcagatcacctgaggttgggagttcgagatgagcctgaccaacatggagaaactctgtttctactagaaatacaaaattagccaggcatggtggcacatgcctgtaatcccaactacttgggaggctgaggcaggagaatcacttgaacccggaaggtggaggttgcagtgagccgagattgcaccattgcactccagcctgggcaacaagagtgaagctccgtctcaaaaaaaaaaaaggtagaatagttaatttggaaatttc

SEQ ID NO: 350384 - DNA, 767 bp, Homo sapiens
gtgaagactgagttttcagttcatgcgagatctgattgtttaaaagagtgcagcacttcctccaccttgctccctctcttgccactgatgtgcctgcttccccttcaccttctgcctggattgtaagctccctgagaacctcaccagaagcagatgccagcaccacgcttcctatacagcctgccaaaatgagctcctgaatttcacagacaaatccagacccctgtgtggaaagcctgcggtggtgttctccgtcttcccacaggactccctgcagccaggaattctaggggagcacctgacgcgaggtatatgcccagatggcctgaagtaactgaagaatcacaaaagaagtgaaaatgtcctgccccgccttaactgatgacattccaccacaaaggaagtgtcaatggctggtccttgccttaactgatgacattccaccgcaaaagaagtgaaaatggccggtccttgccttaactgatgacattccaccgcaaaagaagtgaaaatggccggtccttgccttaagtgatggcattaccttgtgaaagtccttttcctggctcattctggctcaaaatcacccccactgagcaccttgtgacccccactcctgcccgccagggaacaatccccctttgactgtaattttcctttacctacccaaatcttataaaatggccccacccctatctccctttgctgactctctttttggactcagcctgcctgcatccaggtgattaaaagcttttattgctcac

SEQ ID NO: 350385 - DNA, 2126 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350386 - DNA, 1672 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaatgcaatatcatataaattttttgtgatcagtagtcaagttggacttgttttaacgttctgctgcttgagttgcctgatgctcagagctttttggtttggattactattgcaaaagggaacttggtctggctttaagaatgtcctcttggagaaaataacaagagttttaacacttctagatcttagttctagatggagaaagtaacacaaacatcattttactcttatgatcaattgttaattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggtggggaagatattgatgtatctgctactgctttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtaaaaatgcctgatgaagctttattcctgttgcactgactggctctaattttacgtatgtatcaggtacccacatttttgctcccttgaatctccttgactctgtctaactggtgggataaagggagttcaaagtgactatctttgcagctaccataatcaccctctctctctctttgcctgtgccttccatagaataagga

SEQ ID NO: 350387 - DNA, 787 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagagtaagaatggcatgaaaccccatgtgtatttatggtcgagtcatttattagagcattaggatacaggagttatttctaacagtgatcagcagtgctcaaagatgcccagcaagaatatgaacagcttcatattgtatgttcttttgttagaggcctctgtgttttttggagaata

SEQ ID NO: 350388 - DNA, 913 bp, Homo sapiens
tgttattatataaatctattttatttttaataaaacaactaagccaccctcccacccctaaccaaaatttttttatattcatttataattttgatgtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcaaaaaaaaaaaaaaaaaaagaaccaaacacaaaaaaaaaaaaacacaaaaaaacaaaaaaaaaaacaaaaaaaagacagcagaccagaaagaaaaaacaagaaagaagggcgaaagcaacatcacaaacgaggaagcaacaaaaaaaaacaaggggagtggcaacgaacccaaacaaaaggaacaagcaacgacagacagtacggtgagtgacccggggagcaagaatcataacagcaagtaatagaagggggggagccagacgcaaaccacaagaaacggaagcagcgacagaaagaggagagagtctgagaaacaacaaataagaggctacgaggggagaacagaaggcaaaatgaacaaaaacagaaggacacacggcgtggggaaatagcaaatctcacggaagaggaaccaaggcacgagagaaataaaaacaagcacaggcggagggaggaaaacaagagggagggga

SEQ ID NO: 350389 - DNA, 830 bp, Homo sapiens
actagttctagatcgcgagcggcgccctttttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcaaaaaaaaaaaaaaaaaaacaaaaaaaaaaaaaaaaaaaaaaagaaaagaaaaaaaaaaaaaaaaataaacaaacaataaaccgaaagaaaacgaaaaagaaaaaaggaaaatagaaaacaagaaaacaagcgaggagggggggggggcgccccaaggaatatgctttactggccggggggggggcacgccacgttccggcgacaccacctctcgtattgactaaacgagagacgtgcttcctacagttagggatagagctataaatctaacaacacacacagcgcgcacgacggtatcaatcaaccactaaacgccgttgtatcggacaatgaaaacagccggatctaagtagcgcgttatatgttgttagggagccacaccaccatactttcttggtcttggagcgagagtgttaatacaaataacgaacaaaccacactatgccatcatgagtatacatcgcgcccgaagagggtaatactatcttagtatgtggtcatgtgtgtctgatggttgctcaaccaccgcgaatcattcgtcggtgtgaagaggaaactcgacttctagccaaggatatgttatagtgcaaaaaatttttacaagacggcgtttatattaataagcg

SEQ ID NO: 350390 - DNA, 331 bp, Homo sapiens
  misc_feature (1)..(2): n is a, c, g, or t
  misc_feature (182)..(183): n is a, c, g, or t
  misc_feature (209)..(210): n is a, c, g, or t
  misc_feature (214)..(214): n is a, c, g, or t
nnttgcgcatcttcataacagatttgtttacaagtcctggattttctgcagagcttcattatttcagttacttctctgataaggagaatagagttcactagcagctttcacatttccaagcaccaaactcatcttgtttgttcaattttgtcccttctgtcgtcttctcgcagcccgttaanngcacgcgcgaattcgcggccgcgtcnncacnacagaagggcaaacctaattcttgtagatgcattagtgttgaaccaatgctttctcatgtctcaattctttgtatatgcattcttttcagatgtattaaacaaacaaaaacccttca

SEQ ID NO: 350391 - DNA, 2170 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcaaaaaaaaaaggaagcaggggaaccctcaagagtcgcctggcggg

SEQ ID NO: 350392 - DNA, 2071 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaatgttgaaccaatgctttctcatgtctcaattctttgtatatgcattcttttcagatgtattaaacaaacaaaaacccttca

SEQ ID NO: 350393 - DNA, 2266 bp, Homo sapiens
gcggccgcggcggggcggtggcaggagggcagctcgctggctgctcgcggcggtgcctgtccgagctcccctccgcgccggccgcgtcctctgggcggggtggccccgagccacggcctccaggctgctcttcctttcggaggtcgagttcctagcatttccatccgctcctccagcccgctccctgccggtttagctgaagcttccctttcgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350394 - DNA, 2174 bp, Homo sapiens
ggtcagccgaggagaccccgcgcagtgctgccaacgccccggtggagaagctgcagtgcgcctctgccccccgagttcaagcgattctcctgcctcaggctcctgagtagctgggactacaaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350395 - DNA, 2198 bp, Homo sapiens
gcggccgcggcggggcggtggcaggagggcagctcgctggctgctcgcggcggtgcctgtccgagctcccctccgcgccggccgcgtcctctgggcggggtggccccgagccacggcctccaggctgctcttcctttcggaggtcaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350396 - DNA, 1571 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgttttttttttttttttttttttgtggtggtttataaaaccagggccttgcttgtgtgtggtgtgaacttgtgttaaccaaattactgtgggaagtctgtggctggacaccgtctgctctccgtgtgtgtctcccacatctgtgtggaagagagttcactctgtgggggccacctcttttaaaggtgtctcgtgtgtcttgtgggttttttttctccccctctcctttcttttttctttggtggggggcgggaagtgtggctgtgtgtgcgggtgggatgtggttctctttctgacacttgtgtgtgttgtttctcagaattttctcataattacaccacccagcagtgggtgtgtttagaccgcccccctttaaaggggggggagcaagtagagtgcgacgcgtagtgtgtgaggtgtctcccaaatgattctccacatacttttctccctggtacgcactacttcctacgtggtgtctgcaggagaaacaacactgttttgttgttgtccctcccatacttctgttgtgggtgcggctcctttatagaagaggaaagcgggagttgtataataaagagaaacaaaaatgcgcgca

SEQ ID NO: 350397 - DNA, 2009 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagaggcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350398 - DNA, 1717 bp, Homo sapiens
gtctacctcgtgttcatcacctctcaattccatgccttaccggatcctaactgcaggcatctcctgacctctctatactctaaccgattgcttggtctcagtgcaatgcatgattgcattaaaagcacgtccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350399 - DNA, 1685 bp, Homo sapiens
agtgccctggacaaatcttggtgaagtgagattattgtgttgagattcagggttgtttttaatgtttctttctttgccaactcttgggggtttgaatgttttaaatttgaactccaactttattatactgaaaatcagaccgcccattttttctttctaccccttttcagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350400 - DNA, 1026 bp, Homo sapiens
cgatggaacctcactacacactccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350401 - DNA, 868 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccttttggaaaggtggggtggggatcatataaaagcatgtaatcaactaagataaattaatcgtttgatatgaaagctgactaacaatgatcgttaaagctagtgtggcccttcctcaatagtaatgggatggtggaaaggggaatttggggc

SEQ ID NO: 350402 - DNA, 1352 bp, Homo sapiens
cataagcctgaaattgtaatagatttatttccaaaatgtgttagaagtcaacatattgcattttaataaaaattgctttcctgctcagttaaccttgcttgaggtgaagtttttggtcagttatctactctcctggttataatgggcttaagatctagcattctagcgtttttattaaggcacattgcttctgtgaattcagctcatttaatccggactgctgttgtacctgctagtctttctaatcctctaacctggctgctattctctctcctcccctctgtcttgtagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaatgcaatatcatataaattttttgtgatcagtagtcaagttggacttgttttaacgttctgctgcttgagttgcctgatgctcagagctttttggtttggattactattgcaaaagggaacttggtctggctttaagaatgtcctcttggagaaaataacaagagttttaacacttctagatcttagttctagatggagaaagtaacacaaacatcattttactcttatgatcaattgttaattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggtggggaagatattgatgtatctgctactgctttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtaaaaatgcctgatgaagctttattcctgttgcactgactggctctaattttacgtatgtatcaggtacccacatttttgctcccttgaatctccttgactctgtctaactggtgggataaagggagttcaaagtgactatctttgcagctaccataatcaccctctctctctctttgcctgtgccttccatagaataagga

SEQ ID NO: 350403 - DNA, 1645 bp, Homo sapiens
cttgggatcaaactgatcaaactaaagaacatgtgaaacaaccttgggtggtaaacttgtggcttcagatttaggtgattttaggtgagtctgtagacctgggtcctaagtaccaccaatgctgagtcacactgtcatgttggagtttctggctgaggtgtaagtgtatttctgtatcttaatccccgtaagatctgagaatattcttcgttttcactccatgctttatgctctgatacccatgcagacatcttaaagcactggactgcttgctaaaactcattctaggaccccattctttgttttcttatgacttgggtggtggttacttgctctaataacattgctgaataactgaagtgtatgctgtttttagagtctgttctttaaagtccttctagttggtactgttgcacaattaacactttttaaatgtctgaacctttccgttctgggaaaccagtttactctgaaatcttgattaatcacattcagctcatttaatccggactgctgttgtacctgctagtctttctaatcctctaacctggctgctattctctctcctcccctctgtcttgtagagaggtctgaagaatgtgtttgatgaggctatcctagctgccctcgagcctccggaaactcaacccaaaaggaagtgctgtatattctaaactgttttctccttcccttctttgctgctgcttcctgtcccactactgtagaaagatcgtttaaaaacaaaggaataaaaccatcctgtttgaaagcctctgcgtctttttactcaccaccttagagcaacctctgtattagtttttgatcaagaatgcaatatcatataaattttttgtgatcagtagtcaagttggacttgttttaacgttctgctgcttgagttgcctgatgctcagagctttttggtttggattactattgcaaaagggaacttggtctggctttaagaatgtcctcttggagaaaataacaagagttttaacacttctagatcttagttctagatggagaaagtaacacaaacatcattttactcttatgatcaattgttaattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggtggggaagatattgatgtatctgctactgctttatgagttcatttgttacattatcttttaagaataacatccatttaaacagttgacttacagtttgttaatgctgagatgtaaagctgccacctttatattttcctgcttctgattttattgtgagggaaatatacaattgtggttaccttcaaattttgaaattaaaaatatacaaccgtttgtaaaaatgcctgatgaagctttattcctgttgcactgactggctctaattttacgtatgtatcaggtacccacatttttgctcccttgaatctccttgactctgtctaactggtgggataaagggagttcaaagtgactatctttgcagctaccataatcaccctctctctctctttgcctgtgccttccatagaataagga

SEQ ID NO: 350404 - DNA, 2187 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcacaagccaaaaaaacccacgcgtccgctagttctagatcgcgagcggcgctctagagtattc

SEQ ID NO: 350405 - DNA, 2599 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcaaaaaaaaaaaaaaaaaaagaaccaaacacaaaaaaaaaaaaacacaaaaaaacaaaaaaaaaaacaaaaaaaagacagcagaccagaaagaaaaaacaagaaagaagggcgaaagcaacatcacaaacgaggaagcaacaaaaaaaaacaaggggagtggcaacgaacccaaacaaaaggaacaagcaacgacagacagtacggtgagtgacccggggagcaagaatcataacagcaagtaatagaagggggggagccagacgcaaaccacaagaaacggaagcagcgacagaaagaggagagagtctgagaaacaacaaataagaggctacgaggggagaacagaaggcaaaatgaacaaaaacagaaggacacacggcgtggggaaatagcaaatctcacggaagaggaaccaaggcacgagagaaataaaaacaagcacaggcggagggaggaaaacaagagggagggga

SEQ ID NO: 350406 - DNA, 2285 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttcaaaaaaaaaaaaaaaaaaaaaaaaactcgatttaaattcagaaaaattgtgtttatctttagaattttgtattcaatactttatgtactatgtgactcatgcttctggataaataaagcaccaaatatgtatctgtaaccacaatcacacatattatatt

SEQ ID NO: 350407 - DNA, 1836 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350408 - DNA, 2233 bp, Homo sapiens
ggtcagccgaggagaccccgcgcagtgctgccaacgccccggtggagaagctgagacggagtctcactgtgttgcccaggctggagtgcagtggcgccatcttggctcactgcagtgcgcctctgccccccgagttcaagcgattctcctgcctcaggctcctgagtagctgggactacaaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350409 - DNA, 2192 bp, Homo sapiens
ttccggttcccgcgcggcgctccaaagctcggggagtggtggtctccctttcctggagtcatttgtgggagttagggtcttatcctgatctttcctcgtcccccgctcccccgtcctccgaggtggcagctgcgtaggtaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350410 - DNA, 2303 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactatcttgacttctcatgggtaaattatatacactttaaacagctgaaaaatcagtggaaagtcagaaggggtgacacagggtttgcaagaagtgctgggaggcaaaactccagtagacaagattctaacgagtggtggtctcaatttggtgaagtatgccctacatcttggaatgagggtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctcccagtactagttaattttgagtaattgtattgtcagaaaagtgattagtactatttttttttgttgtttcaaaaaaaaaatttttgtgtgtgtgtttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttca

SEQ ID NO: 350411 - DNA, 1795 bp, Homo sapiens
  misc_feature (1127)..(1127): n is a, c, g, or t
  misc_feature (1343)..(1343): n is a, c, g, or t
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcaggccggcccggcgcccacctacaatcaccccgacggcaccgagccaccgcagctcgcccccccccatattatacagagcgccggcacacaagacagacctactgatacacattacgcagagcgagccgcgcgcaacaacaaacacgcgacgcagtcagcacaaccacgcgcggcacgagcatctatcggggcacacacacaccacggacngaggcacgaaacaccacacgcggcacaccacctccgagatcagacaaacagacacacgcccgccaggcgaactaacaaaaaaccactcaggggcgtgcctagcacgaggcgaaccacacgccaaccgctacaaccaagcccacgcggagaaaacgaaaagctgaccccacccgagcacatataaggacaaacaatatatctcaaccgccgaacgcnctgcttaacaaacaccacgaccgaacaaaaagcacaagagacaaaacccaaccaaccaacgcagaacgacactcagaagccgaaacaacagcaagacgaacagaacaacgcaaaacacgcggagccagaacaacgaacaaccgaccccacacaaagcccacagaccaagcacacacaaccagcgacacacaccaaagcagccccagacccacacagccaccaaccacacgcgcagacagcacaaccacgcccacaacagcacaccagacagcccacgagacaccacacaccccaaaaccaacgataagccgaccacaagcgagcaccacgcccgacaacgaccgaccgaagcacacaacaccaacaaacccaaatacgaaaaagacaacacaaccacgaaaaccacaagacacacacaaagacagacgcaacaacaagacagcgcacagcgt

SEQ ID NO: 350412 - DNA, 806 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagtggaaccagggagcagcttcaacaattccaattagtctgttacagagtcatccacaagcatgccttgcttttaaacaacaaaaaaaaaaaa

SEQ ID NO: 350413 - DNA, 894 bp, Homo sapiens
gtcaggtgcgtgcccctgtccggcagccgaggagaccccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccagataatgccccggcactgaagtcgggacacaatcagctttaaccaactggatgacggggggtggccacaggagatggggagaggagtctgaactacaacccctggctcttgtgcacactgcatacgtttcagaactcctggatggtaaccatctctggagtgcagcgcttgctgcagtggacatgatcaggaata

SEQ ID NO: 350414 - DNA, 469 bp, Homo sapiens
actgtttataaatataatttgaatggtagatatttgccattcaaataaccagaaaagttatttggtccctaagtaattgaggctatgtgcatgcagagataacctgtgtcctgcttttatcagttcactgctcagttttatcatttctttccatgactttcttttttctttttgagagtttcatttggccagccatggtagctcatccttgtaatcccagcactttaggaggctgaggtgggaggattgcttgagctcaggaattggagatgagcctgggcaacatagagagaccccgtctctacaaaaaataaaaagaattaagccaggaatggtagcacatgcctgtagtcccagctacacaagaggcttaggtgggagtatcacttgagcccgggaaattgaggctgtagtgagccgtgatggtgccactgtactcctgggtgacagaatgagaccctgtctcaaa

SEQ ID NO: 350415 - DNA, 1719 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaa

SEQ ID NO: 350416 - DNA, 1678 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaata

SEQ ID NO: 350417 - DNA, 2381 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaaggtattaactcatactatattcttggataaaataaccttttaaaatactttagcacatatgcttaaaatctaagttaacagatttgtcttagtccatttgtgctgctataacaaaataccacagatttggtaatttataaacaacagaaatctgtttttcctggctcttgaggctgggaattccaagaccaatgcaccagcagaattagtgtctggtgaaggctgatctctgcttccaagatggcacctcattgctgcatcctccacagtggaggaatgtatgtcctcacatggtggaagggacagaagggaaagaggagcaaaatgctttcaaaagagcatttaatctcattcattactcagtcacctcttaaaggccacatcctttaatactgttgctttggggattaagtttcgacatgaattttggaggggacaaaaacatccaaaccatagcaacataaatgtatagaatatttcacacaaagcagagtgctgggtaatgaccagatataaagaagtatttgaaatgaccttacctccaagatgcttatactcttagaaaagttgacaggtacagatggctgtaatttgaagcagcaggtaggattcattgcacctattattcattaaacacctgttgtatgtcttctactgtaaaa

SEQ ID NO: 350418 - DNA, 2271 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaaaaaaaagagaacaagacaaaaacacacaacaaacgaaagaagaaaagacaacaagaaagaaacaacaaaaacaaaaaaaaaagaaccaaaggaggggggggggcgcgctctaatagtattatccacccggcggggcggcgaccacatgtcgtcggacgcgcccacacccttgttgttactggaaagagcggggccccccatggtgaggggagatattatataaacaggagagagcgcacgcgggccggtctgtattaacaacatagacgtcgttgatgggacagaaacaaccactgtggtggtcggcaagttctttacgtgagcaacgcacaccaatcttcctggtgtgggggggcacaacatgtcgtgcgcaagccacccgctcccagaatgaattattcagcccccccacggtggatataattcaatacatcgctgagcagtctctcatcggtagtgaacacaccagctcacgtgcttatcgtcgtccgcccgcgatagtatctgtgccacaacgagtgtgtattttacagaatataatatacaaaggag

SEQ ID NO: 350419 - DNA, 1214 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatatctgtgaccaacaagatggagaataagaggat

SEQ ID NO: 350420 - DNA, 1479 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaa

SEQ ID NO: 350421 - DNA, 1175 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccgggtaaggctgctcaaactcaactctgatagaa

SEQ ID NO: 350422 - DNA, 962 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagagtaagtagcatcttatattgatatagtcttgctttgaagtaactgcagaagagattcc

SEQ ID NO: 350423 - DNA, 1338 bp, Homo sapiens
  misc_feature (105)..(105): n is a, c, g, or t
  misc_feature (108)..(108): n is a, c, g, or t
  misc_feature (110)..(110): n is a, c, g, or t
  misc_feature (113)..(113): n is a, c, g, or t
  misc_feature (115)..(116): n is a, c, g, or t
accaaagctgttctccaggagtttggtagaatcgacattctggtcaacaatggtggaatgtcccagcgttctctgtgcatggataccagcttggatgtctacagnaancnaananngcttagggttcggaattacaaaaccaaattccctgctaaggctaaagttgatctgaacaaaagtaagggcaaggcaaagagaatagacattagacagggacctgaaaggatccagaaatgggactttacatcccacagaggaaacagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaa

SEQ ID NO: 350424 - DNA, 2090 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaaaaaaaaaaaaaaaaaaaaaaaaaaacagaagagagagagaaaaaaaaaaagaaaaagggtgggggggagaaagagaaagaaagaaaaaattggggggggggagaaagggggggacgggggagaactccaacaacacctgcccgttgaccacggcgagaactaccccaaaaaaacgcccgcgagcaaccagccttacacaacggaagtaccctcaacacaagcggtaaacaggctgcacaacatataagccggggggataacagccaacagaaaaaccccccggcgaaaaagcaacgcgaaaaaagagcacaccgaaccacagcccgactatcgacacacagccaacgagactgagcaaaacaaagaaaaaa

SEQ ID NO: 350425 - DNA, 914 bp, Homo sapiens
gagtatcccggagacggcggcataatagcagcctcggtaggctccagcacgggttcccatgaagcggctacaaagctgtcctccaggagattcggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaa

SEQ ID NO: 350426 - DNA, 1145 bp, Homo sapiens
tttctcgacctcatgaaaagatactgaagcttgaaaaggggatgttctttctgaataggaatggagaagaggggccaagcaagaatgattctatctgtctcctggccgttgatagtgtccctgtacagagaggaaataacgtagtataatatgtagcttatgtttgaatcagcttctttaaaaatactggaattttatttatttatttttggtagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccaggtgaggaccggccaaagcctctcccgagtgggaggccgggctcggagctgccgaggcgtgtccgggtctccgggggttctgcagtgatcccgggtcctttgtgggttgcgtggagcttcccgaaggcccggctgccccttacgcaggggctgcgggttggggaggaagaggcgagggctaaaaagcccctttgtcttctgtactggtcggaagatggcatggacttgccattcaggctaggaaacctctccagggagtgccaaactgttaagagagcactggagtcggcggtgctcctgaggactctgacatcttacgcaggactcaagggattctggtgttgtctcagaggacgatactttgagaaacagtgagcgtccccctgcgtttgtaagggaaactcctttgtaagtaccggaagcccggtcgttctactacctgaagtagtctgtcctccacttcccactcctgcagttttgaaataaaatctgagataatccg

SEQ ID NO: 350427 - DNA, 511 bp, Homo sapiens
  misc_feature (25)..(25): n is a, c, g, or t
  misc_feature (27)..(27): n is a, c, g, or t
  misc_feature (31)..(31): n is a, c, g, or t
ctaaaccccctacctcaaacaacananaccnccccttcagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactga

SEQ ID NO: 350428 - DNA, 3676 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctcagtttaaactccacttccttagggatgtctctgtgacctccctgtgctggattagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaaca

SEQ ID NO: 350429 - DNA, 4199 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctcagtttaaactccacttccttagggatgtctctgtgacctccctgtgctggattagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaacaaacaaaagaaacgaagaacaaaaaaaaaaaaaaaaaaagcaaagaaaaagaagggggggggcggcgatgaattaatctatacggcaccgagagaaggagacaaagaatccaacccgaacacccagctataaagaagaaagagagcgcgacaccaatggagagggaagtaaaatataaggaggcagagagagcgcgactgataaaacaacaccgcacagcatgaagggcaaaacaaacacgcgagatagacgaagtaaaaggaagaagaaaacacaaacaccacaaccagcttgggagcgtgccaattacaagaagaagagaacaacacaccacacctacaacagaaagaacacgaccaccaaagtcagagaaacaacaaagaaccaaacggcagacgcctacggacgggagcgaacagcacacaagactagtagacgccaggacgagagagacaaacatcaccgccaccacacagaacaagaagaaaacacaacacaaacgggcacaagacataaaacaccgt

SEQ ID NO: 350430 - DNA, 3371 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctagtaaaatataacactgatcttgggatatacgctcacgtaaaaataccaacct

SEQ ID NO: 350431 - DNA, 2445 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctcctgagccccctgcccccagagcaataaaagtcagctgggctttcctcgaaaaaagacacaacacgacacagaaccacagacaagt

SEQ ID NO: 350432 - DNA, 3562 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacaggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctcagtttaaactccacttccttagggatgtctctgtgacctccctgtgctggattagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaaca

SEQ ID NO: 350433 - DNA, 2853 bp, Homo sapiens
ataatacagcagatacttcttccccagttgccgctttaaccaaggggggtcctgccaagaaaatggtaccctgcttgcgtacaatgatgttttcatcagccatggcaggcacataggctcctcctgcggtgcaggagcccatgaccactgcgatctgtgcaccctagcaattaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctcagtttaaactccacttccttagggatgtctctgtgacctccctgtgctggattagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaaca

SEQ ID NO: 350434 - DNA, 2004 bp, Homo sapiens
  misc_feature (25)..(25): n is a, c, g, or t
  misc_feature (27)..(27): n is a, c, g, or t
  misc_feature (31)..(31): n is a, c, g, or t
ctaaaccccctacctcaaacaacananaccnccccttcagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctcagtttaaactccacttccttagggatgtctctgtgacctccctgtgctggattagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaaca

SEQ ID NO: 350435 - DNA, 1512 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacagtataaaggtgaagaattgaaaatacgaacattttctgctgctttgaaaatcaggaatctcttgtttcaagactttgatacacttgacatgggctttgttgttgagagcactacaaatgtgtgagccacttttaaaaggaactgctttataaacataatttgtagcttaatggcttcatggatccaaatagtttaaaatgttaatagctagatgctgtggtgtgggtccctatctgtgactttgtgacattagttgtataaaaaggttcttatagtaaaattagtagaaaataaaattgtagt

SEQ ID NO: 350436 - DNA, 1367 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaaggtactcactttgtccgttatgctgccaagaaattcctctgctgttcctcaaacatacgctgaatttgaagggaccggcca

SEQ ID NO: 350437 - DNA, 2117 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacaggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacagcccttggaaaagcacaagacataaatcttctttgaactttcttttgaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactga

SEQ ID NO: 350438 - DNA, 4281 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctcagtttaaactccacttccttagggatgtctctgtgacctccctgtgctggattagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaacaaaaaaaaaaaaaaaaaaaaaaaaaaaaaaaaaaaaaaaaaaaaaaaaaaaaaaaaaaaaaaaaaaaaaaaaaaaaaaaaaaaaacaaaagaaacgaagaacaaaaaaaaaaaaaaaaaaagcaaagaaaaagaagggggggggcggcgatgaattaatctatacggcaccgagagaaggagacaaagaatccaacccgaacacccagctataaagaagaaagagagcgcgacaccaatggagagggaagtaaaatataaggaggcagagagagcgcgactgataaaacaacaccgcacagcatgaagggcaaaacaaacacgcgagatagacgaagtaaaaggaagaagaaaacacaaacaccacaaccagcttgggagcgtgccaattacaagaagaagagaacaacacaccacacctacaacagaaagaacacgaccaccaaagtcagagaaacaacaaagaaccaaacggcagacgcctacggacgggagcgaacagcacacaagactagtagacgccaggacgagagagacaaacatcaccgccaccacacagaacaagaagaaaacacaacacaaacgggcacaagacataaaacaccgt

SEQ ID NO: 350439 - DNA, 3345 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttctacctcactgtgtacccccctagcctagcctccctataccttgtggccattccccgccgggtatcc

SEQ ID NO: 350440 - DNA, 3383 bp, Homo sapiens
gagttaaggttcaaacgtggcaaagcaagcctccaccagcagaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttatggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagtggcataaagtgccctcacactgctgtgcagccatcaccaccattcatctccagaatttgttctcagtcccaaactgaaactataccattcaaacaacagcgctccccatttccccctcccccgagcccatgacatctccttattattattttttttttgagacagggtgtttctctgttgcccaggctggagtgcggtggtgtgatctcggctcactgcagcttccacctcccgggttcaagcgattcttgtgcctcagcctcccaagcagctgggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagccaccgcgcctgaccacatctccttattcttaaatgtatgtgtttctcatggtttgatttattcttgctgggccatttcagcccctgtcatggcttcactcgccatctaaatgcagatgattactgccttgacggttcttaacccagctctcccctgagctgcaggcctgcatatccagtaggtctactggacatctgtactggttgttgtggaggaacctctggcttgctcattaagtcctactgattttcactatcccctgaatttccccacttatttttgtctttcactatcgcaggccttagaagaggtctacctgcctccagtcttacctagtccagtctaccccctggagttagaatggccatcctgaagtgaaaagtaatgtcacattactcccttcagtgatttcttgtagaagtgccaatccctgaatgccaccaagatcttaatcttcacatctttaatcttatctctttgactcctctttacaccggagaacggctccagctgttctagctctctttcagttctttgaaccttcccaccttagggtctataaggttccctctgcccaaattgttctactctcccttcttcttcaacacatccttcagtttaagcacttgcttctctcagtttaaactccacttccttagggatgtctctgtgacctccctgtgctggattagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaaca

SEQ ID NO: 350441 - DNA, 2881 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaacaaaaaaaaaaaaaaaaaaaaaaaaaaaaaaaaaaaaaaaaaaaaaaaaaaaaaaaaaaaaaaaaaaaaaaaaaaaaaaaaaaaaacaaaagaaacgaagaacaaaaaaaaaaaaaaaaaaagcaaagaaaaagaagggggggggcggcgatgaattaatctatacggcaccgagagaaggagacaaagaatccaacccgaacacccagctataaagaagaaagagagcgcgacaccaatggagagggaagtaaaatataaggaggcagagagagcgcgactgataaaacaacaccgcacagcatgaagggcaaaacaaacacgcgagatagacgaagtaaaaggaagaagaaaacacaaacaccacaaccagcttgggagcgtgccaattacaagaagaagagaacaacacaccacacctacaacagaaagaacacgaccaccaaagtcagagaaacaacaaagaaccaaacggcagacgcctacggacgggagcgaacagcacacaagactagtagacgccaggacgagagagacaaacatcaccgccaccacacagaacaagaagaaaacacaacacaaacgggcacaagacataaaacaccgt

SEQ ID NO: 350442 - DNA, 1813 bp, Homo sapiens
acaggcctgagaatcagagaagccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcttccctactctatgctcttgtaaaacactatctacttcctttgtcataaactcatcattttcctataaacattaatattgtcctcctgctagaatgtaagctccgtgagagcaaggatcctcctgtttaccctgtacctccaatgtctggcacttgtaggtgctcaaatattcgttgaatgaatgaaaaatccatattgtaattgatgtcctctggccacatagttttaaaattaggtgattgattatatgaccgaatagaactatcaaatgttttcctaataaagtcaatatttcaaaca

SEQ ID NO: 350443 - DNA, 288 bp, Homo sapiens
tatctgttttgtattttattttcttggctggagtttccaaaaacaacagggtgtttgtcagttattggttagaaaaacaagtaattgagtttcttgtttggatttcatgcaaccacataagcttattaaaagacaattcaccatggcatttccatatatcttgtattagttcttgttctggactatcgtcccaaggttgtttaatagcagatagccttgaaatatagcaatagtgtttccttctggggcagagaatagatttatttgatcaggataataaagataagg

SEQ ID NO: 350444 - DNA, 945 bp, Homo sapiens
gtgcgggtcagcgacgactcgtgtaagacacaatgtcatgcgttactttcgcactctgggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaattggttgggaattggccgcactcaagcacaatttgggtttcttagccaacatcgtttgttagccacgaaataggaggccatttgggaaacggtcggttacctggcag

SEQ ID NO: 350445 - DNA, 747 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaagaaaaaaaaaaaaaaaaaaaaaaacttggggggggcttgggccttgggaaagtttttgggaaccatgggttgggggagggggcccagagggtccagggacccgggccaaagcggacccagagaaaccggggacaggacaaagggccggggtcctcaccattaaaaagggcgggggaacacgagggggtcgtgaaaatcccaggggaccggagggcaaacgggctcttcaccgggaccaggagcgcgatatgggcgccgggggggagat

SEQ ID NO: 350446 - DNA, 1392 bp, Homo sapiens
cgccacgcacctgcgtcagctcgctctgcgcgtgcgccggtggcgggactctggggaaaatggctgcgtcttcgagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350447 - DNA, 1309 bp, Homo sapiens
gaaggcccgggtggtgaccgagctgtgctgaatagatccagcatgtgcatgtgcgtgagtgtctttactggctcgtatcaaccaggagtcccaagcgatctcgatatccatgttacgccccgccagtgtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350448 - DNA, 1115 bp, Homo sapiens
gcctggctgtgcttatcttctatagagcgggacaggtgaatgggcttgtgctggctatggtcggtacagacaaagggaaacaccggttgtctccctattgtctggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350449 - DNA, 1108 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttagtttaagcatagtgatatagggatgtcaattctgtgaagggtgtagtgtttac

SEQ ID NO: 350450 - DNA, 1238 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350451 - DNA, 1071 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaattggttgggaattggccgcactcaagcacaatttgggtttcttagccaacatcgtttgttagccacgaaataggaggccatttgggaaacggtcggttacctggcag

SEQ ID NO: 350452 - DNA, 953 bp, Homo sapiens
ggtcaacgaccgtccgtgtaatatgacggctgtgttaggagtcaggtgagtgtaatgctatatgtgctccactgagctgggttccgtgggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350453 - DNA, 780 bp, Homo sapiens
tggtgagaaggagaaggagcggctgggaggcggtttgggagtggcgggtggtaacagcacacgagagcggctgctgtctgcgcttgaggacttggaggtcctgtctaggtaatgcggcgagcctgagagccgggctggagctgggccgggggactgaccccggagccggccggccctgcgtttgtgctcgttctcggggttcggcggggagggccagctcgggagtttcgggtgcatgagggtcatggacgtggggtccgcagccctctggcactctgggcggcggtttttcccgttagagggaattttagtaatgataagaactcgcgcggtctgagcctcttcgtccgcggccagccacttaacatttatggaacgctccttgggggctcagcattggggagacggtagtgaagggtagactggatgccagctgtcgagagagagacagatgtgtaaactggcttggggcctgtttttattagagggctgcgctgcggggtactggagcacagggactaggcaccttttttggttgtagtcagggcaggccctctgaagaaagtgctgcttgggaagcatgagctcgccaaactcactaggcagcacagatagatggaacagcaagtgcaaaaagcctggcttggtggagttgcaagttgtttaggatggttgtgtgtcagagataggagatgaaattagatgtcgttcttcatattctgtcacctttcatgataagtctttcaagttgaagccttccttgactccctcccattgact

SEQ ID NO: 350454 - DNA, 1433 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350455 - DNA, 2239 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgtatgctttttttttagtttaaatatactgtcagtgtaggtaggaaattatttctgtaaatccagttgcattttataatacttgagtgactaactgaattgaaacctattacaattaatagggttctcaaaggcctattcctattagaagaaataattttttttaataattgaaaaaatttaccacagccttgtctgattttaagaatagattgtgtgaagatttagaatggaaagcaaccatttcttcccttcaccttcctcttcttacagttccccaggagtcatttttaaccacttttaatttctgttggtaacctctgtgtttaggtaatatgcttatacaactatttcttgatgtatcagttttagacaatgtatcttctgatttcaaaggtaatacaacatttaatgtgaaacatttagtgaatacagtaaaggagaaaataaaattgttagcattctacccagagataatatcaattcatattgtagtgtagatttttttaaagttcacatacacttttttgtaaaatgagaataatgtttatttcctgagatactgctgtattttttaattgctaatctgtattcttcaaatgaactgagaattccatttttccatcaaaaaaaaaaggggcgcgtttaaattccctacagggccaagttcggatacgatttttggtaaagggggccaaggggagattaaggagacagcggataaggggagggacaggatggttgtgagcacatttgggcaatccaaccaaatgcaggaaaataaggatgaaagcacgaagaagcacaata

SEQ ID NO: 350456 - DNA, 2338 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgtatgctttttttttagtttaaatatactgtcagtgtaggtaggaaattatttctgtaaatccagttgcattttataatacttgagtgactaactgaattgaaacctattacaattaatagggttctcaaaggcctattcctattagaagaaataattttttttaataattgaaaaaatttaccacagccttgtctgattttaagaatagattgtgtgaagatttagaatggaaagcaaccatttcttcccttcaccttcctcttcttacagttccccaggagtcatttttaaccacttttaatttctgttggtaacctctgtgtttaggtaatatgcttatacaactatttcttgatgtatcagttttagacaatgtatcttctgatttcaaaggtaatacaacatttaatgtgaaacatttagtgaatacagtaaaggagaaaataaaattgttagcattctacccagagataatatcaattcatattgtagtgtagatttttttaaagttcacatacacttttttgtaaaatgagaataatgtttatttcctgagatactgctgtattttttaattgctaatctgtattcttcaaatgaactgagaattccatttttccatcattttttccttttgattattttcgatctctagaaaaattggaaaataggagattaatcttatattttcaccatctagaattaaggacatacaatgtttgaatgtctttccctccagggttatttttaggaatggactaacacaatatctaattttaaccttgccttgtccgtatactaggaatattgatccatgtgtatacattcttgaaagatttactttaatggctaaaattttattgtggtatgtgccataatgtaactgcctgtttttatcaccaaatc

SEQ ID NO: 350457 - DNA, 1325 bp, Homo sapiens
cgccacgcacctgcgtcagctcgctctgcgcgtgcgccggtggcgggactctggggaaaatggctgcgtcttcgagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350458 - DNA, 1223 bp, Homo sapiens
  misc_feature (1198)..(1198): n is a, c, g, or t
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgaggtantccatgaggggggatcctctatggt

SEQ ID NO: 350459 - DNA, 1307 bp, Homo sapiens
gtgcgggtcagcgacgactcgtgtaagacacaatgtcatgcgttactttcgcactctgggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350460 - DNA, 1372 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaattttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350461 - DNA, 1381 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggcaacagctgtttaccaagcgaaggagaaactcaagtcaatagaaaaagcaagaaaagtaatgctgtatgtgctccactgacctgggttccaggggacccccggagaccctacccaactgatttagagatgagaagtgggttactgggtcagatgaacaatccttccactaatggcgtgaatggccatttaccaggagatgcacttgcagcaggaagattgccagatgtccttgctccacagtatccatggcagtcaaatgacatgtcgatgaatatgttaccaccaaatcatagtagtgactttttgttggaacctcctgggcataataaagaaaatgaagatgatgtagagattatgtcaacggactcctcaagcagtagtagtgagtctgattgaaaaaccttaaaagacaatatacagaattgaatactgtagaattctgtttctttaacagtagcagggaaatgtaaactacaggtgacaaaaaatacccaggtaaacactggctttggtagaattgtgcagtcattaaaagtcaaaattttttgactttctttttaaagccaaagaccatagttttagttttaagccactaggtagatatttaggggaatagtcaaaatttactgttgaaaaagcagttgctatgtgctttcttaccctgttctgttccagttttgctggatttgtacatagccattctagaaatagagttgagggaaattatccatatacatatcactaataggcttcttggaattatttagaaaagcatttttaaactggcagtggatgactgaataggcatcatatttctttttgtgtgtcatttaaaagtaacaaaaactgccatttgacagtaaaggctcttggcttctgttggaggcatgggaaattgtctcaatttgtacagtttgtaattgtaatttttgtaaataaatttgtttgtacattgta

SEQ ID NO: 350462 - DNA, 659 bp, Homo sapiens
cgccacgcacctgcgtcagctcgctctgcgcgtgcgccggtggcgggactctggggaaaatggctgcgtcttcgagtggtgagaaggagaaggagcggctgggaggcggtttgggagtggcgggtggtaacagcacacgagagcggctgctgtctgcgcttgaggacttggaggtcctgtctagggaacttatagaaatgctggcaatttcaagaaaccaaaagttgttacaggctggagaggaaaaccaggtcctggagttgttaattcaccgagatggggaatttcaagaactaatgaaattggcacttaatcagggaaaaattcatcatgaaatgcaagttttagaaaaagaagtagagaagagagacagtgatattcagcagctacaaaaacagctaaaggaagcagaacaaatactggtaagttgacagaggttggttcttaaggttaaaaaggatgttgtttaatctgtttctgaaaaatctgttatcaatattttgaagagcagaaaactagactttccaagtctaaaggtgatatcttgtcactcaccattgccagtggttaaatgaaaggctattgtcattctcttttttacttactgttttcaaatagtctgcattacttgtgagccacattttcgatgctcggtcgaa

SEQ ID NO: 350463 - DNA, 703 bp, Homo sapiens
gccctgtgtggtcccgggcgtcctgggtctggttttgagtggctcggccactaccatccgacttggtcccattcctacaacggctgtttagtcggcccccttttctgacatcttacgtgggattcccgccatctggagcaattttgtcgaaccaggtctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtataaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaa

SEQ ID NO: 350464 - DNA, 2382 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaa

SEQ ID NO: 350465 - DNA, 2854 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaaaaaaaaaaaaaaaaaaaaaaaaaaaaaaaaaaaaaaaaaaaaaaaaaaaaaaaaaaagagaaacaaagaaagacagacgaaaaaaagagagagaaacaaaacacacgcacaacaatcaagacgacagcaccacacgcgagccaactaggcgcgacgtaagagagcacacgacaaaacgaaacaacacaccacaccccgagccaacacacatcaagagacagaaacgaccacacgacgcacgaaggaaaccagcaggaagaagccgcaactccggaccgcaccggccggcacagcgggcaggacacgacaccacctcacacaaacgagcccgaggaaccacagcgcagacaacacacgaaagacacagaccgaataacacgccacaacacagcaaaacaaagaacaaacgcagaagagcaacagcggacagacacaccagcaccagagacacacgaagcgcagcagaaaagaa

SEQ ID NO: 350466 - DNA, 3319 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaagtat

SEQ ID NO: 350467 - DNA, 3486 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagagtctccctctgtctccaggctggagatcagaatcttggctcactgcaacctccgcctcctgggttcaagtgattcttctgcctcagcctcccaagtggctgggactacagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaagtat

SEQ ID NO: 350468 - DNA, 3330 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaagtat

SEQ ID NO: 350469 - DNA, 3168 bp, Homo sapiens
aacacaatgcaaagttaaacaaaacaccagccgggtactcaggcctgggcccaccaaagaagaaataaagacataatgatatcttatagtgaaatcaaccttcagaaacaaaggtatttaaaattaccaagtgacccttttggggtctacaacacttaccagaccttaagaaagcggaagacggagagacgactgcatcaggaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaagtat

SEQ ID NO: 350470 - DNA, 2364 bp, Homo sapiens
cctgtgcccctagccatgatggcttcgggtaggggttgatctctgtcaccttctttaccatctggaggcaatgtaagcacccactgcagccctatagtctgctgcaactatgactccatgccagaacttgaagaccagggtggtgattccaggaagcattttgattccctgctcctctgagactccccagctgggcatggccagcctcagcccatcagtgggactccctggacccagatccagcagatctgcataaactcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaagtat

SEQ ID NO: 350471 - DNA, 1130 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagcacatctattcctgacgacattgaatgcccaccactagtaccttccagctcgaccatatgggcaacaattggatgggcacactctctgtaccacactactatttgggacaaaactccacaaaatgactggatggctggaaccaaccagacttgtcagaacttgcagcgagactgcccccatgggtacatttaacctgccgcgcggtgaaaatcgacattgcgcaaaaagtgccacaaatagaggaaaacgggctgacgcctggggcaagcctaca

SEQ ID NO: 350472 - DNA, 345 bp, Homo sapiens
ctctgaaattatggtgatgatttggtaaaagatactagaattgacagcaaggaaagcataccacattcatattttcttcctcaactcacaggagtttcctttgcttcaaaataaaagtgaaacaggagattggaataatttttgtgcaatacaacaaaatactgaagttatttatttccccagttcagttagaatgctttgttttacacttaacaaatgagtggattaagatggtctaattcaaagttttcttcatttaacaggatggaaacttctctgtcagtactatattggaaaaacctcaaaatatgatggtggttggacagtcagcatttgcagactttg

SEQ ID NO: 350473 - DNA, 2213 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttt

SEQ ID NO: 350474 - DNA, 3375 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaagtat

SEQ ID NO: 350475 - DNA, 3309 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgaattttgttcttatttttttctttatagttcactgagattggcatgtgtttttactttgtatctaagcatgttaacatgtcttcttaataaatattccttattgaaacaaagtat

SEQ ID NO: 350476 - DNA, 2396 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagccgctgatacagtatgtagccgagaagccctcgggtgtcttgtatgatctttactgtatcaatgcctttagtagaagcatggatggaatggctgctcttctgatgttagtgttaacgcttactatgcgcttgactatataggggggatcacatcttattgatttcgatgcatcccatgctattcatggcaagagtgctcataaataaggtgtgaatccgccacccgggcccgcaatagataagtaggttcatatctgtaatgtggggggagttttgcgcagaaccgatggattgtgcatccattgtggagatgtggggcatgattgccagtggatgggttgtggtgtggtgtattggatggtgattatgaggcaaagttcagtgaataataataatttaatttgctggagaat

SEQ ID NO: 350477 - DNA, 1679 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgacagacctaaatcaaattaaggatgccatggttgccaccttctttgacatttacgaagatggaatcttggacattgtagtgctaagtaaaggatatacaaagaatgattttgccattcatacactaaaaaataactttgaagcagatgcttattttgttaaagttattggtgagtaaagtactaacatttaattttgttctctttctcttcccctctctccacatattccaaagagcaaggacatgctccgatgtacaaccctctagatcagatcaacacgtcagcagcttcaggggggatccttagagtcggccgaa

SEQ ID NO: 350478 - DNA, 1490 bp, Homo sapiens
agcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagaaatgacttaatcgtctttttggcagaccagaatgcaccctattttaaacccaaagtaaaggtatctttcaagaatcacagtgcattgataacaagtgtagtccctggggattatgatggagattctcaaatggatgtccttctgacatatcttcccaaaaattatgccaagagtgaattaggagctgttatcttctggggacaaaatcaaacattagatcctaacaatatgaccatactcaataggacttttcaagatgagccactaattatggatttcaatggtgatctaattcctgatatttttggtatcacaaatgaatccaaccagccacagatactattaggagggaatttatcatggcatccagcattgaccactacaagtaaaatgcgaattccacattctcatgcatttattgatctgactgaagattttacagcagatttattcctgacgacattgaatgccaccactagtaccttccagtttgaaatatgggaaaatttggatggaaacttctctgtcagtactatattggaaaaacctcaaaatatgatggtggttggacagtcagcatttgcagactttgatggagatggacacatggatcatttactgccaggctgtgaagataaaaattgccaaaagagtaccatctacttagtgagatctgggatgaagcagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaagcaaccagcaggcctttttactggagaacgtcccttgtaataatgcaagctgtgaagaggcgcgtcgaatgtttaaagtctactgggagctgaggagggttctggtcactagcagactcatttcattcaccccttggaatctgcccagatccatcatccatccattcaaccaatgattcatccatccatccatccatcgatctatcagacatccatcataa
